United States Patent 11,723,967 (ZIKA VIRUS VACCINE) - sequence listing, part 5

SEQ ID NO: 5711 - RNA, 2449 nt, Artificial Sequence
  KX827309.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5712 - RNA, 2449 nt, Artificial Sequence
  KU955593.1 prME-short mRNA Design 2 GC
ggggcgcugccuacggagguggcagccaucuccuucucggcaucaagcuuaccaugaccagcgugggcaucgucgggcugcuccugaccacggccauggccguggaggugacccgccggggcaacgcguacuacauguaccuggaccgcuccgacgccggggaggccaucagcuuccccaccaccaugggcaugaacaagugcuacauccagaucauggaccucgggcacaugugcgacgccacgauguccuacgagugcccgaugcuggacgagggcgucgagcccgacgacguggacugcuggugcaacaccaccagcaccuggguggucuacggcacgugccaccacaagaagggggaggcccggcgcucccggcgcgcggugacccugcccagccacuccacccggaagcuccagacccgcagccagacguggcuggagucccgggaguacaccaagcaccugauccgcguggagaacuggaucuuccggaaccccggcuucgcccucgccgccgcggccaucgccuggcugcuggggagcuccaccagccagaaggucaucuaccucgugaugauccugcugaucgccccggccuacuccauccgcugcaucggcgugagcaaccgggacuucgucgaggggauguccggcggcaccuggguggacgugguccucgagcacgggggcugcgugacggugauggcgcaggacaagcccaccgucgacaucgagcuggugaccaccacggugagcaacauggccgagguccgcuccuacugcuacgaggccagcaucuccgacauggccagcgacagccggugccccacccagggggaggccuaccuggacaagcaguccgacacccaguacgugugcaagcgcacccucguggaccggggcuggggcaacgggugcggccuguucgggaagggcagccuggucacgugcgcgaaguucgccugcuccaagaagaugaccggcaagagcauccagcccgagaaccucgaguaccgcaucaugcuguccgugcacgggagccagcacuccggcaugaucgucaacgacaccgggcacgagaccgacgagaaccgggccaagguggagaucacgccgaacagcccccgcgccgaggccacccugggcggguucggcucccucgggcuggacugcgagccccggaccggccuggacuucagcgaccucuacuaccugaccaugaacaacaagcacuggcuggugcacaaggagugguuccacgacaucccccucccguggcacgcgggcgccgacacggggacgccccacuggaacaacaaggaggcccuggucgaguucaaggacgcccacgccaagcgccagaccguggugguccugggcucccaggagggggcggugcacaccgcccucgccggcgcccuggaggcggagauggacggggccaagggccgccugagcuccggccaccucaagugccggcugaagauggacaagcugcgccucaagggggugagcuacucccugugcaccgccgccuucaccuucaccaagauccccgccgagacccugcacggcaccgucacgguggaggugcaguacgcggggaccgacggccccugcaaggucccggcccagauggccguggacaugcagacccucacccccgugggccggcugaucacggccaaccccgucaucaccgagagcaccgagaacuccaagaugaugcuggagcucgacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccugaacucccucggcaaggggauccaccagaucuucggcgcggccuucaagagccuguucggcgggauguccugguucagccagauccugaucggcacccugcucgucuggcuggggcugaacacgaagaacggcuccaucagccucaugugccuggcccucgggggcgugcugaucuuccuguccaccgccgugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5713 - RNA, 2449 nt, Artificial Sequence
  KY272987.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccuggugugccuggcccucgggggcguccugaucuuccugagcaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5714 - RNA, 2449 nt, Artificial Sequence
  KY007221.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcgugaacaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccuggugugccuggcccucgggggcguccugaucuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5715 - RNA, 2449 nt, Artificial Sequence
  EU545988.1 prME-short mRNA Design 2 GC
ggggcgcugccuacggagguggcagccaucuccuucucggcaucaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggccaucgccuggcugcucggguccagcaccucccagaaggucaucuaccuggugaugauccugcucaucgccccggccuacagcauccgcugcaucggcguguccaaccgggacuucgucgaggggaugagcggcggcaccuggguggacgugguccuggagcacgggggcugcgugacggugauggcgcaggacaagcccgccgucgacaucgagcuggugaccaccaccguguccaacauggccgagguccgcagcuacugcuacgaggccuccaucagcgacauggccagcgacucccggugccccacgcagggggaggcguaccucgacaagcagagcgacacccaguacgugugcaagcgcacccugguggaccggggcuggggcaacgggugcggccuguucgggaagggcucccucgugaccugcgccaaguucgccugcagcaagaagaugacggggaaguccauccagcccgagaaccuggaguaccgcaucaugcugagcguccacggcucccagcacagcggcaugaucgucaacgacaccgggcacgagaccgacgagaaccgggccaagguggagaucaccccgaacagcccccgcgccgaggcgacgcucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacaccgggacgccccacuggaacaacaaggaggcccuggucgaguucaaggacgcccacgcgaagcgccagaccguggugguccucggcagccaggagggggccgugcacaccgcccuggccggcgcgcuggaggccgagauggacggggccaagggccgccucuccagcggccaccugaagugccggcugaagauggacaagcuccgccugaaggggguguccuacagccugugcaccgccgccuucacguucaccaagauccccgcggagacccuccacggcaccgucaccguggaggugcaguacgccgggacggacggccccugcaaggucccggcccagauggccguggacaugcagacccugacccccgugggccggcugaucaccgccaaccccgucaucacggaguccaccgagaacagcaagaugaugcucgagcuggacccgcccuucggggacuccuacaucgugaucggcgugggggagaagaagaucacccaccacuggcaccgcagcggcagcaccaucgggaaggcguucgaggccacgguccggggcgccaagcgcauggccgugcugggcgacaccgccugggacuucggguccgugggcggggcgcucaacagccugggcaaggggauccaccagaucuucggcgccgccuucaagucccuguucggcgggaugagcugguucucccagauccugaucggcacccuccuggucuggcuggggcucaacaccaagaacggcagcaucucccugacgugccuggcccucgggggcgugcugaucuuccugagcaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5716 - RNA, 2449 nt, Artificial Sequence
  KU681082.3 prME-short mRNA Design 2 GC
ggggcgcugccuacggagguggcagccaucuccuucucggcaucaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggucaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcccaggacaagcccaccguggacaucgagcuggugaccaccacggucuccaacauggcggaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgccaaguucgcgugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgccggcgcggacacggggacgccccacuggaacaacaaggaggcccugguggaguucaaggacgcccacgccaagcgccagaccguggucgugcucggcagccaggagggggccgugcacaccgcgcuggccggcgcccuggaggccgagauggacggggcgaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgccgggaccgacggccccugcaaggugccggcgcagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcagcacgaucgggaaggccuucgaggccaccgugcggggcgcgaagcgcauggccgugcugggcgacaccgccugggacuucggguccgucggcggggcccucaacagccugggcaaggggauccaccagaucuucggcgccgcguucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5717 - RNA, 2449 nt, Artificial Sequence
  KX601167.1 prME-short mRNA Design 2 GC
ggggcgcugccuacggagguggcagccaucuccuucucggcaucaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacacggggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgcggggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggacaagaagaucacccaccacugguaccgcagcggcagcacgaucgggaaggccuucgaggcgaccgugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5718 - RNA, 2449 nt, Artificial Sequence
  KX694533.2 prME-short mRNA Design 2 GC
ggggcgcugccuacggagguggcagccaucuccuucucggcaucaagcuuaccaugaccagcgugggcaucgucgggcugcuccugaccacggccauggccguggaggugacccgccggggcuccgcguacuacauguaccuggaccgcagcgacgccgggaaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaucgggcacgagaccgacgagaaccgggccaagguggagaucaccccgaacagcccccgcgccgaggccacgcucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacaccgggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucacguucaccaagauccccgccgagacccuccacggcaccgugaccguggagguccaguacgcggggacggacggccccugcaaggugccggcccagauggccguggacaugcagacccugacccccgucggccggcugaucaccgccaaccccgugaucacggaguccaccgagaacagcaagaugaugcucgagcuggacccgcccuucggggacuccuacaucgugaucggcgucggggacaagaagaucacccaccacuggcaccgcagcggcagcaccaucgggaaggccuucgaggcgacggugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacaccaagaacggcagcaucucccugacgugccuggcccucgggggcgugcugaucuuccugagcaccgccgucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5719 - RNA, 2449 nt, Artificial Sequence
  KY288905.1 prME-short mRNA Design 2 GC
ggggcgcugccuacggagguggcagccaucuccuucucggcaucaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgcgaagguggaggucacccccaacuccccgcgggccgaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcgcugguggaguucaaggacgcccacgccaagcggcagacggucguggugcucggcagccaggagggggccguccacaccgcccuggcgggcgcccuggaggccgagauggacggggccaagggccgccucuucuccggccaccugaagugccgccugaagauggacaagcuccggcugaagggggugagcuacucccugugcaccgcggccuucaccuucaccaaggugcccgccgagacgcuccacggcaccgucaccguggaggugcaguacgccgggaccgacggccccugcaagguccccgcccagauggcgguggacaugcagacgcugaccccggugggccgccugaucaccgccaaccccgucaucaccgagagcacggagaacuccaagaugaugcucgagcuggacccgcccuucggggacagcuacaucgugaucggcgugggggacaagaagaucacccaccacuggcaccgguccggcagcaccaucgggaaggccuucgaggccaccguccgcggcgccaagcggauggcggugcugggcgacacggccugggacuucgggagcgugggcggggucuucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgugaugaucuuccucuccacggcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5720 - RNA, 2449 nt, Artificial Sequence
  KF268950.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggggaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaaggucgaggugacccccaacuccccgcgggccgaggccacgcucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacaccgggacgccgcacuggaacaacaaggaggcccuggucgaguucaaggacgcccacgccaagcggcagaccguggugguccucggcagccaggagggggcggugcacaccgcccuggccggcgcccuggaggcggagauggacggggccaagggccgccucuucuccggccaccugaagugccgccugaagauggacaagcuccggcugaagggggugagcuacucccugugcaccgccgccuucacguucaccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaagggggugcaccagaucuucggcgccgcguucaagagccuguucggcgggauguccugguucagccagauccugaucggcacccugcucgucuggcuggggcugaacaccaagaacggcuccaucagccucacgugccuggcccugggcggcgugaugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5721 - RNA, 2449 nt, Artificial Sequence
  KF383121.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaucgggcacgagaccgacgagaaccgcgccaagguggaggugacccccaacuccccgcgggccgaggccacccucggcggguucggcagccuggggcuggacugcgagccccgcaccggccucgacuucuccgaccuguacuaccugaccaugaacaacaagcacuggcucguccacaaggagugguuccacgacaucccccugcccuggcacgccggcgcggacacggggaccccgcacuggaacaacaaggaggcccugguggaguucaaggacgcccacgccaagcggcagaccguggucgugcucggcagccaggagggggccgugcacaccgcgcuggccggcgcccuggaggccgagauggacggggcgaagggccgccucuucuccggccaccugaagugccgccugaagauggacaagcuccggcugaagggggucagcuacucccugugcacggccgccuucaccuucaccaaggugcccgccgagacccuccacggcaccgugacggucgaggugcaguacgccgggaccgacggccccugcaaggugcccgcgcagauggccgucgacaugcagacccugaccccggugggccgccugaucacggccaaccccgugaucaccgagagcaccgagaacuccaagaugaugcucgagcuggacccgcccuucggggacagcuacaucgucaucggcgugggggacaagaagaucacccaccacuggcaccgguccggcagcacgaucgggaaggccuucgaggccaccgugcgcggcgcgaagcggauggccguccugggcgacaccgccugggacuucgggagcgugggcgggguguucaacucccucggcaaggggauccaccagaucuucggcgccgccuucaagagccuguucggcgggauguccugguucagccagauccugaucggcacccugcucgucuggcuggggcugaacacgaagaacggcuccaucagccugaccugccuggcgcucgggggcgugaugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5722 - RNA, 2431 nt, Artificial Sequence
  KF268949.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggcgaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgccaaggucgaggugacccccaacuccccgcgggccgaggccacccucgggggcuucgggagccugggccuggacugcgagccccgcacggggcucgacuucuccgaccuguacuaccugaccaugaacaacaagcacuggcucgugcacaaggagugguuccacgacaucccccugcccuggcacgcgggcgccgacaccggcaccccgcacuggaacaacaaggaggcccuggucgaguucaaggacgcccacgccaagcggcagacgguggugguccucgggagccaggagggcgcggugcacaccgcccuggccggggcccuggaggcggagauggacggcgccaaggggcgccucuucuccggccaccugaagugccgccugaagauggacaagcuccggcugaagggcgugagcuacucccugugcaccgccgccuucaccuucacgaagguccccgccgagacccuccacgggaccgugaccguggagguccaguacgcgggcaccgacgggcccugcaaggugcccgcccagauggccguggacaugcagacgcugaccccggucggccgccugaucaccgccaaccccgugaucaccgagagcacggagaacuccaagaugaugcucgagcuggacccgcccuucggcgacagcuacaucgugaucggggucggcgacaagaagaucacccaccacuggcaccgguccgggagcaccaucggcaaggccuucgaggcgaccgugcgcggggccaagcggauggccgugcugggcgacacggccugggacuucggcagcgucgggggcguguucaacucccucgggaagggcauccaccagaucuucggggccgcguucaagagccuguucggcggcauguccugguucagccagauccugaucgggacccugcucguguggcugggccugaacaccaagaacggguccaucagccugaccugccucgcccugggcggggucaugaucuuccucuccacggccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5723 - RNA, 2449 nt, Artificial Sequence
  KU955595.1 prME-short mRNA Design 2 GC
ggggcgcugccuacggagguggcagccaucuccuucucggcaucaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugacgaugaacaacaagcacuggcucgugcacaaggagugguuccacgacaucccccugcccuggcacgccggcgcggacaccgggaccccgcacuggaacaacaaggaggcccugguggaguucaaggacgcccacgccaagcggcagaccgucguggugcucggcagccaggagggggccguccacacggcgcuggccggcgcccuggaggccgagauggacggggcgaagggccgccucuucuccggccaccugaagugccgccugaagauggacaagcuccggcugaagggggugagcuacucccugugcaccgccgccuucaccuucaccaaggugcccgccgagacccuccacggcacggucaccguggaggugcaguacgccgggaccgacggccccugcaagguccccgcgcagauggccguggacaugcagacccugacgccggugggccgccugaucaccgccaaccccgucaucaccgagagcaccgagaacuccaagaugaugcucgagcuggacccgcccuucggggacagcuacaucgugaucggcgugggggacaagaagaucacgcaccacuggcaccgguccggcagcaccaucgggaaggccuucgaggccaccguccgcggcgcgaagcggauggccgugcugggcgacaccgccugggacuucgggagcgugggcggggucuucaacucccucggcaaggggauccaccagaucuucggcgccgccuucaagagccuguucggcgggauguccugguucagccagauccugaucggcacgcugcucguguggcuggggcugaacaccaagaacggcuccaucagccugaccugccuggcgcucgggggcgugaugaucuuccucuccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5724 - RNA, 2449 nt, Artificial Sequence
  KF383116.1 prME-short mRNA Design 2 GC
ggggcgcugccuacggagguggcagccaucuccuucucggcaucaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccagcacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccugguggaguucaaggacgcccacgccaagcggcagaccgucguggugcucggcagccaggagggggccguccacaccgcgcuggccggcgcccuggaggccgagauggacggggcgaagggccgccucuucuccggccaccugaagugccgccugaagauggacaagcuccggcugaagggggugagcuacucccugugcacggccgugugcaccgccgccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaaggggauccaccagaucuucggcgccgcguucaagagccuguucggcgggauguccugguucagccagauccugaucggcacccugcucguguggcuggggcugaacaccaagaacggcuccaucagccucacgugccuggcccucgggggcgucaugaucuuccuguccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5725 - RNA, 2431 nt, Artificial Sequence
  KX601166.1 prME-short mRNA Design 2 GC
ggggcgcugccuacggagguggcagccaucuccuucucggcaucaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacgagaaccgcgccaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgcggacaccggcacgccgcacuggaacaacaaggaggcccugguggaguucaaggacgcccacgccaagcggcagaccgucguggugcucgggagccaggagggcgccguccacaccgcgcuggccggggcccuggaggccgagauggacggcgcgaaggggcgccucuucuccggccaccugaagugccgccugaagauggacaagcuccggcugaagggcgugagcuacucccugugcaccgccgccuucacguucaccaaggugcccgccgagacccuccacgggaccgucaccguggaggugcaguacgccggcacggacgggcccugcaagguccccgcgcagauggccguggacaugcagacccugaccccggugggccgccugaucaccgccaaccccgucaucacggagagcaccgagaacuccaagaugaugcucgagcuggacccgcccuucggcgacagcuacaucgugaucggggugggcgacaagaagaucacccaccacuggcaccgguccgggagcaccaucggcaaggccuucgaggccacgguccgcggggcgaagcggauggccgugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacaccaagaacggguccaucagccucacgugccuggcgcugggcggggugaugaucuuccucuccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5726 - RNA, 2449 nt, Artificial Sequence
  KF383118.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagccggacgacguggacugcuggugcaacaccaccuccaccugggucguguacggcacgugccaccacaagaagggggagacccggcgcagccggcgcuccgugagccuccgguaccacuacacccgcaagcugcagacccggucccagacguggcuggagagccgcgaguacaagaagcaccucaucauggucgagaacuggaucuuccggaaccccggcuucgccaucguguccguggccaucaccuggcugauggggagccugaccucccagaaggucaucuaccucgugaugaucgugcugaucguccccgccuacagcaucuccugcaucggcgugagcaaccgcgaccugguggaggggauguccggcggcaccugggucgacguggugcucgagcacgggggcugcgucacggagauggcgcaggacaagcccaccguggacaucgagcuggugaccaugaccgucagcaacauggccgaggugcgguccuacugcuacgaggccagccugagcgacauggccuccgccagccgcugcccgacgcagggggagcccucccucgacaagcagagcgacacccaguccgugugcaagcggacccugggcgaccgcggcugggggaacggcugcgggaucuucggcaaggggagccuggugaccugcuccaaguucacgugcugcaagaagaugcccggcaagagcauccagcccgagaaccucgaguaccggaucaugcugccggugcacggcucccagcacagcgggaugaucgucaacgacaucggccacgagaccgacgagaaccgcgcgaagguggaggugacccccaacagcccccgggccgaggccacccucgggggcuucgggucccugggccuggacugcgagccccgcacgggccuggacuucuccgaccucuacuaccugaccaugaacaacaagcacuggcugguccacaaggagugguuccacgacaucccgcuccccuggcacgccggggccgacaccggcacgccccacuggaacaacaaggaggcgcugguggaguucaaggacgcccacgccaagcggcagaccguggucgugcuggggagccaggagggcgccgugcacaccgcccucgcgggggcccuggaggccgagauggacggcgccaagggccgccuguucuccgggcaccucaagugccgccugaagauggacaagcugcggcucaagggcgucagcuacucccugugcaccgccgcguucaccuucacgaaggugcccgccgagacccugcacgggaccgugaccgucgaggugcagagcgccggcaccgacggcccgugcaaggugcccgcccagauggcggucgacaugcagacgcucacccccguggggcgccugaucaccgccaaccccgugaucaccgaguccacggagaacagcaagaugaugcuggagcucgacccgcccuucggcgacagcuacaucgucaucggggugggcgacaagaagaucacccaccacuggcaccgguccgggagcaccaucggcaaggccuucgaggccaccgugcgcggcgccaagcggauggcgguccugggggacacggccugggacuucggcuccgucgggggcguguucaacagccuggggaagggcauccaccagaucuucggcgccgccuucaagucccucuucgggggcaugagcugguucucccagauccugaucgggacccugcuggucuggcucggccugaacaccaagaacgggagcaucucccugaccugccucgcccugggcggcgugaugaucuuccugagcacggcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5727 - RNA, 2446 nt, Artificial Sequence
  KX447520.1 prME-short mRNA Design 2 GC
ggggcgcugccuacggagguggcagccaucuccuucucggcaucaagcuuaccaugagcgugggcaucgucgggcugcuccugaccaccgccauggccgcggaggugacgcgccggggcuccgccuacuacauguaccuggaccgcaacgacgccggggaggccaucagcuuccccaccacccucggcaugaacaagugcuacauccagaucauggaccuggggcacaugugcgacgccaccauguccuacgagugcccgaugcuggacgagggcguggagcccgacgacgucgacugcuggugcaacacgaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5728 - RNA, 2449 nt, Artificial Sequence
  KU761561.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgcccgccggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5729 - RNA, 2449 nt, Artificial Sequence
  KX806557.2 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauguuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5730 - RNA, 2449 nt, Artificial Sequence
  LC191864.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaugaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5731 - RNA, 2449 nt, Artificial Sequence
  KU744693.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggccauggcccaggacaagcccaccguggacaucgagcuggugaccaccacggucagcaacauggccgaggugcgcuccuacugcuacgaggccagcaucuccgacauggcgagcgacagccggugccccacccagggggaggccuaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugcucgucaacgacaccgggcacgagaccgacgagaaccgggccaagguggagaucacgccgaacagcccccgcgcggaggccacccugggcggguucggcucccuggggcucgacugcgagccccggaccggccuggacuucagcgaccuguacuaccucaccaugaacaacaagcacuggcuggcccacaaggagugguuccacgacaucccccugccguggcacgccggcgccgcgacggggacgccccacuggaacaacaaggaggcccucgucgaguucaaggacgcccacgccaagcgccagaccguggugguccugggcucccaggagggggcggugcacaccgcccuggccggcgcccucgaggccgagauggacggggcgaagggccgccugagcuccggccaccugaagugccggcucaagauggacaagcugcgccugaagggggugagcuacucccucugcaccgccgccuucaccuucaccaagauccccgccgagaccgucgacggcaccgugacgguggaggggcaguacggcggcaccgacgggcccugcaaggucccggcccagauggcgguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucggcaaggccuucgaggccaccguccgcggggccaagcggauggcggugcugggcgacaccgccugggacuucgggagcgugggcggggcccucaacucccugggcaagggcauccaccagaucaucggggccgcguucaagagccuguucggcgggauguccugguucagccagauccugaucggcacccuccugauguggcuggggcucaacacgaagaacggcuccaucagccugaugugccuggcccucggcgggguccugaucuuccuguccaccgccgugagcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5732 - RNA, 2440 nt, Artificial Sequence
  KU963574.2 prME-short mRNA Design 2 GC
ggggcgcugccuacggagguggcagccaucuccuucucggcaucaagcuuaccaugggcgccgacgccagcaucgggaucgugucccugcuccugaccaccgucauggcggccgagaucacgcgccggggcagcgccuacuacauguaccuggaccgcuccgacgccgggaaggccaucagcuucgugaccacccucggcgugaacaagugccacguccagaucauggaccuggggcacaugugcgacgcgaccauguccuacgagugccccaugcuggacgagggcguggagcccgacgacguggacugcuggugcaacacgaccagcaccugggucguguacgggaccugccaccacaagaagggggaggcccggcgcucccggcgcgccgugacgcuccccagccacuccacccggaagcugcagacccgcagccagaccuggcuggagucccgggaguacacgaagcaccucaucaaggucgagaacuggaucuuccgcaaccccggcuucgcccugguggcgguggccaucgccuggcugcucgggagcuccaccagccagaaggucaucuaccuggugaugauccugcucaucgcccccgccuacuccauccggugcaucggcgugagcaaccgcgacuucgucgaggggauguccggcggcaccuggguggacgugguccuggagcacgggggcugcgugaccgugauggcgcaggacaagccgacggucgacaucgagcuggugaccaccaccgugagcaacauggccgagguccgguccuacugcuacgaggccagcaucagcgacauggccuccgacagccgcugccccacgcagggggaggccuaccucgacaagcaguccgacacccaguacgugugcaagcggacccuggucgaccgcggcuggggcaacgggugcggccuguucgggaagggcagccucgugaccugcgcgaaguucacgugcuccaagaagaugaccggcaagagcauccagcccgagaaccuggaguaccggaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgccgacaccgagaccccgcacuggaacaacaaggaggcgcugguggaguucaaggacgcccacgccaagcggcagacgguggucgugcucggcagccaggagggggccgugcacaccgcccuggcgggcgcccuggaggccgagauggacggggccaagggccgccucuccagcgggcaccugaagugccgccugaagauggacaagcuccggcugaagggcgucuccuacagccugugcaccgcggccuucaccuucacgaaggugcccgccgagacccuccacggcaccgugaccgucgaggugcaguacgccgggcgcgacggccccugcaaggugcccgcccagauggcggucgacaugcagacccugacgccgguggggcggcugaucaccgccaaccccgugaucaccgaguccaccgagaacagcaagaugaugcucgagcuggacccgcccuucggcgacagcuacaucgucaucggcgugggggacaagaagaucacgcaccacuggcaccgcuccggcagcaucaucgggaaggccuucgaggccaccgugcggggcgccaagcgcauggcgguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcccucgggggcgugaugaucuuccucagcaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5733 - RNA, 2458 nt, Artificial Sequence
  KF383120.1 prME-short mRNA Design 2 GC
ggggcgcugccuacggagguggcagccaucuccuucucggcaucaagcuuaccaugggcgccgacaccagcaucgggaucaucggccugcuccugaccacggccauggcggccgagaucacccgccggggguccgccuacuacauguaccuggaccgcagcgacgccggcaaggccaucuccuucgcgaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccggcccagccgccgggccgugacccugcccucccacagcacccgcaagcuccagacccggucccagacguggcuggagagccgcgaguacaccaagcaccugaucaaggucgagaacuggauccuccggaaccccggguucaccguggcggcccuggccauggccuggcugcucggcaacuccaccagccagcgcgugaucuaccuggucaugauccugcucaucgccccggcguacuccauccggugcaucggggugagcaaccgcgacuucguggagggcauguccggcgggacgugggucgacguggugcuggagcacggcgggugcgucaccgugauggcccaggacaagcccaccguggacaucgagcuggucaccacgaccgugagcaacauggccgaggugcgguccuacugcuacgaggccagcaucuccgacauggccagcgacagccgcugccccacccagggcgaggcguaccucgacaagcaguccgacacccaguacgucugcaagcggacgcugguggaccgcggcugggggaacggcugcgggcuguucggcaaggggagccucgugaccugcgccaaguucacgugcuccaagaagaugaccggcaagagcauccagcccgagaaccuggaguaccggaucaugcuguccguccacggcagccagcacuccgggaugaucgugaacgacaucggccacgagaccgacgagaaccgcgccaaggucgaggugaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgcgggggccgacaccggcacgccccacuggaacaacaaggaggcccuggucgaguucaaggacgcccacgccaagcggcagaccguggugguccucgggucccaggagggcgcggugcacaccgcccuggccggggcccuggaggcggagauggacggcgccaagggccgccucuucagcgggcaccugaagugccgcaucaagauggacaagcugcggcucaagggcguguccuacagccugugcaccgccgccuucaccuucuccaagguccccgccgagacccugcacgggaccgugacgguggagguccaguacgcgggccgcgacggccccugcaaggugccggcccagauggccguggacaugcagacccucacccccgucgggcggcugaucaccgccaaccccaucaucacggagagcaccgagaacucccgcaugaugcuggagcucgacccgcccuucggcgacagcuacaucgugaucggggugggcgacaagaagaucacccaccacuggcaccgguccgggagcaccaucggcaaggccuucgaggcgacgguccgcggcgccaagcggauggccgugcugggggacaccgccugggacuucggcagcgucgggggcguguucaacucccuggggaagggcgugcaccagguguucggcgccgcguucaagagccucuucgggggcauguccugguucagccagauccugaucgggacccugcuggucuggcucggccugaacaccaagaacggguccaucagccuggccugccucgcccugggcggcgccaugaucuuccuguccacggcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5734 - RNA, 1741 nt, Artificial Sequence; identical to SEQ ID NO: 304
  KU321639.1 solE mRNA Design 2 GC

SEQ ID NO: 5735 - RNA, 1741 nt, Artificial Sequence; identical to SEQ ID NO: 309
  KU312312.1 solE mRNA Design 2 GC

SEQ ID NO: 5736 - RNA, 1729 nt, Artificial Sequence; identical to SEQ ID NO: 314
  AY632535.2 solE mRNA Design 2 GC

SEQ ID NO: 5737 - RNA, 1741 nt, Artificial Sequence; identical to SEQ ID NO: 5512
  KU527068.1 solE mRNA Design 2 GC

SEQ ID NO: 5738 - RNA, 1741 nt, Artificial Sequence
  KX421193.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5739 - RNA, 1741 nt, Artificial Sequence
  LC002520.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaccgugaacgacaucggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5740 - RNA, 1723 nt, Artificial Sequence
  DQ859059.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacgcgggcgccgacaccgggaccccgcacuggaacaacaaggaggcccucguggaguucaaggacgcccacgccaagcgccagacggucguggugcugggcagccaggagggggcgguccacaccgcccuggccggcgcccucgaggccgagauggacggcgcgaaggggcggcuguucagcggccaccugaagugccgccucaagauggacaagcugcggcugaaggggguguccuacagccucugcaccgccgccuucaccuucacgaagguccccgccgagacccugcacggcaccgugaccguggagguccaguacgccgggacggacggccccugcaaggugcccgcgcagauggccguggacaugcagacccugaccccggucggccgccucaucaccgccaaccccgugaucacggaguccaccgagaacagcaagaugaugcuggagcuggacccgcccuucggggacuccuacaucgugaucggcgucggggacaagaagaucacccaccacuggcaccggagcggcuccaccaucgggaaggccuucgaggccacggugcgcggcgcgaagcggauggccgugcucggcgacaccgccugggacuucgggagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5741 - RNA, 1729 nt, Artificial Sequence
  KU963573.2 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgagaaccgggccaagguggaggugacccccaacuccccgcgcgccgaggccacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggcaagcuguucagcgggcaccugaagugccggcucaagauggacaagcugcgccugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcggcucaucacggccaaccccgucaucaccgaguccaccgagaacagcaagaugaugcuggagcuggacccgcccuucggcgacuccuacaucgugaucggggugggcgacaagaagaucacccaccacuggcaccgcagcggguccacgaucggcaaggccuucgaggccaccguccggggcgccaagcgcauggcggugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5742 - RNA, 1741 nt, Artificial Sequence
  KY075939.1 solE mRNA Design 2 GC
ggggcgcugccuacggagguggcagccaucuccuucucggcaucaagcuuaccaugagccagaaggugaucuaccuggucaugauccuccugaucgcccccgccuacucccugcgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacuccccgcgcgccgaggcgacgcucgggggcuucggcagccuggggcuggacugcgagccccggaccggccuggacuucuccgaccucuacuaccugaccaugaacaacaagcacuggcugguccacaaggagugguuccacgacaucccccuccccuggcacgccggggccgacaccggcacgccgcacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagauccccgccgagacccugcacgggaccgugacggucgaggugcaguacgcgggcaccgacggccccugcaaggugcccgcccagauggccgucgacaugcagacccucaccccgguggggcgccugaucacggccaaccccgugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5743 - RNA, 1741 nt, Artificial Sequence
  KX447516.1 solE mRNA Design 2 GC
ggggcgcugccuacggagguggcagccaucuccuucucggcaucaagcuuaccaugagcaagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5744 - RNA, 1741 nt, Artificial Sequence
  KX447515.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacugguaccgguccgggagcacgaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5745 - RNA, 1741 nt, Artificial Sequence
  KU758874.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggcaagcugagcuccgggcaccugaagugccggcucaagauggacaagcugcgccugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggcgaccgugcggggcgccaagcgcauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5746 - RNA, 1741 nt, Artificial Sequence
  KU729218.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacacccagacccugacgccgguggggcgccucaucaccgccaaccccgugaucaccgagagcaccgagaacuccaagaugaugcuggagcuggacccgcccuucggcgacagcuacaucgucaucggggugggcgagaagaagaucacgcaccacuggcaccgguccgggagcaccaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5747 - RNA, 1741 nt, Artificial Sequence
  KU501217.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgagauccgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5748 - RNA, 1741 nt, Artificial Sequence
  KU761561.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgcccggcgcauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5749 - RNA, 1741 nt, Artificial Sequence
  KY075937.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggucagcgacucccggugccccacgcagggcgaggccuaccuggacaagcagagcgacacccaguacgugugcaagcgcacccugguggaccggggcugggggaacggcugcgggcuguucggcaaggggucccuggugaccugcgccaaguucgcgugcagcaagaagaugacgggcaaguccauccagcccgagaaccuggaguaccgcaucaugcucagcguccacggcucccagcacagcgggaugaucgugaacgacaccggccacgagaccgacgagaaccgggccaaggucgagaucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5750 - RNA, 1741 nt, Artificial Sequence
  KY014317.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaucgagaacuccaagaugaugcuggagcuggacccgcccuucggcgacagcuacaucgucaucggggugggcgagaagaagaucacccaccacuggcaccgguccgggagcaccaucggcaaggccuucgaggcgacggugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5751 - RNA, 1741 nt, Artificial Sequence
  KU870645.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucgggaucggcgagaagaagaucacccaccacuggcaccgguccgggagcacgaucggcaaggccuucgaggcgaccgugcgcggcgccaagcggauggccgugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5752 - RNA, 1741 nt, Artificial Sequence
  KU922923.1 solE mRNA Design 2 GC
ggggcgcugccuacggagguggcagccaucuccuucucggcaucaagcuuaccaugagccagaaggugaucuaccuggucaugauccuccugaucgcccuggccuacuccauccgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacagcccccgcgccgaggcgacgcucgggggcuucggcucccuggggcuggacugcgagccgcggaccggccuggacuucuccgaccucuacuaccugaccaugaacaacaagcacuggcugguccacaaggagugguuccacgacaucccccuccccuggcacgccggggccgacaccggcacgccccacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagaucccggccgagacccugcacgggaccgugacggucgaggugcaguacgcgggcaccgacggccccugcaaggugcccgcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5753 - RNA, 1741 nt, Artificial Sequence
  KU497555.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggacccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcacggccgccuucaccuucaccaagauccccgccgagacccugcacgggacggugaccgucgaggugcaguacgcgggcaccgacggccccugcaaggugcccgcccagauggccgucgacaugcagacccugacgccgguggggcgccucaucaccgccaaccccgugaucaccgaguccaccgagaacagcaagaugaugcuggagcuggacccgcccuucggcgacuccuacaucgucaucggggugggcgagaagaagaucacgcaccacuggcaccggagcggguccaccaucggcaaggccuucgaggcgaccgugcgcggcgccaagcggauggccguccucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5754 - RNA, 1741 nt, Artificial Sequence
  KU312314.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcuggcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5755 - RNA, 1741 nt, Artificial Sequence
  KY014314.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggaggcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5756 - RNA, 1741 nt, Artificial Sequence
  KX447517.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcggcccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5757 - RNA, 1741 nt, Artificial Sequence
  KU729217.2 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucagcaccaccguguccaacauggccgaggugcgcagcuacugcuacgaggccaccaucuccgacaucgccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccgccgugguccuggggagccaggagggcgccgugcacaccgcccuggccggcgcgcucgaggccgagauggacggggccaagggccggcugagcuccgggcaccugaagugccgccucaagauggacaagcugcggcugaagggcgugagcuacucccucugcaccgccgccuucacguucaccaagauccccgcggagacccugcacgggaccgucacgguggagguccaguacgccggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggcguucgaggccaccgugcgcggcgccaagcggauggccgugcucggggacaccgcgugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5758 - RNA, 1741 nt, Artificial Sequence
  KY328290.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucagcaagauccccgccgagacccugcacgggaccgugaccgaggagguccaguacgcgggcacggacggccccugcaaggugcccgcccagauggccguggacaugcagacccugaccccggucgggcgccucaucaccgccaaccccgugaucacggaguccaccgagaacagcaagaugaugcuggagcuggacccgcccuucggcgacuccuacaucgugaucggggucggcgagaagaagaucacccaccacuggcaccggagcggguccaccaucggcaaggccuucgaggcgacggugcgcggcgccaagcggauggccgugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5759 - RNA, 1741 nt, Artificial Sequence
  KX087101.3 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgagcugcaguacgcgggcaccgacggccccugcaaggugcccgcccagauggccguggacaugcagacccucaccccggucgggcgccugaucacggccaaccccgugaucaccgagagcaccgagaacuccaagaugaugcuggagcucgacccgcccuucggcgacagcuacaucgugaucggggucggcgagaagaagaucacccaccacuggcaccgguccgggagcacgaucggcaaggccuucgaggcgaccgugcgcggcgccaagcggauggccgugcugggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5760 - RNA, 1741 nt, Artificial Sequence
  KY003156.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcaucagcaaccgggacuucguggaggggauguccggcgggaccuggguggacgucgugcuggagcacggcgggugcgugaccgucauggcgcaggacaagcccacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcauccuggggcucgacugcgagccccggaccggccuggacuucagcgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggucccaggagggcgccgugcacaccgcccuggccggcgcccucgaggcggagauggacggggccaagggccggcugagcagcgggcaccugaagugccgccucaagauggacaagcugcggcugaagggcguguccuacagccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgagaagaagaucacccaccacuggcaccggagcggguccacgaucggcaaggccuucgaggcgaccgugcgcggcgccaagcggauggccgugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5761 - RNA, 1741 nt, Artificial Sequence
  KU758876.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggucaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5762 - RNA, 1741 nt, Artificial Sequence
  KU926310.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcgccgacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5763 - RNA, 1741 nt, Artificial Sequence
  KU681081.3 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacaccggggccgacacgggcaccccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcugagcuccgggcaccugaagugccgccucaagauggacaagcugcggcugaagggcgucagcuacucccucugcacggccgccuucaccuucaccaagauccccgccgagacccugcacgggacggugaccgucgaggugcaguacgccggcaccgacggccccugcaaggugcccgcgcagauggccgucgacaugcagacccugacgccgguggggcgccucaucaccgccaaccccgugaucaccgagggcaccgagaacagcaagaugaugcuggagcuggacccgcccuucggggacuccuacaucgucaucggcgugggggagaagaagaucacgcaccacuggcaccggagcggcuccaccaucggcaaggccuucgaggccaccgugcgcggggcgaagcggauggccguccucggcgacaccgccugggacuucgggagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5764 - RNA, 1741 nt, Artificial Sequence
  KU744693.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgcgauggcccaggacaagcccacgguggacaucgagcucgugaccaccaccgucagcaacauggccgaggugcgcuccuacugcuacgaggccagcaucuccgacauggccagcgacucccggugccccacgcagggcgaggcguaccuggacaagcagagcgacacccaguacgugugcaagcgcacccuggucgaccggggcugggggaacggcugcgggcuguucggcaaggggucccuggugaccugcgccaaguucgccugcagcaagaagaugacgggcaaguccauccagcccgagaaccuggaguaccgcaucaugcucagcgugcacggcucccagcacagcgggaugcuggucaacgacaccggccacgagaccgacgagaaccgggccaagguggagaucacccccaacuccccgcgcgcggaggccacgcucgggggcuucggcagccucgggcuggacugcgagccccggaccggccuggacuucuccgaccucuacuaccugaccaugaacaacaagcacuggcuggcccacaaggagugguuccacgacaucccccuccccuggcacgccggggccgcgaccggcacgccgcacuggaacaacaaggaggcccugguggaguucaaggacgcccacgccaagcgccagaccgucguggugcuggggagccaggagggcgccguccacaccgcgcucgccggcgcccuggaggccgagauggacggggccaagggccggcugagcuccgggcaccucaagugccgccugaagauggacaagcugcggcucaagggcgugagcuacucccugugcaccgcggccuucacguucaccaagauccccgccgagaccguggacgggaccgucacgguggagggccaguacggcgggaccgacggccccugcaagguccccgcccagauggccguggacaugcagacccugaccccgguggggcgccucaucacggcgaaccccgucaucaccgagagcaccgagaacuccaagaugaugcuggagcuggacccgcccuucggcgacagcuacaucgugaucggggugggcgagaagaagaucacccaccacuggcaccgguccggcagcacgaucgggaaggccuucgaggccaccguccgcggcgccaagcggauggcggugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5765 - RNA, 1741 nt, Artificial Sequence
  EU545988.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccgccguggacaucgagcucgucacgaccaccgugagcaacauggccgaggugcgcuccuacugcuacgaggccagcaucuccgacauggccagcgacucccggugccccacccagggcgaggcguaccuggacaagcagagcgacacgcaguacgucugcaagcgcacccugguggaccggggcugggggaacggcugcgggcuguucggcaaggggucccuggugaccugcgccaaguucgccugcagcaagaagaugaccggcaaguccauccagcccgagaaccuggaguaccgcaucaugcucagcguccacggcucccagcacagcgggaugaucgugaacgacacgggccacgagaccgacgagaaccgggccaagguggagaucacccccaacuccccgcgcgcggaggccacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5766 - RNA, 1741 nt, Artificial Sequence
  KY007221.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugaacaaccgggacuucguggaggggaugagcggcgggaccugggucgacguggugcuggagcacggcgggugcgucaccgugauggcgcaggacaagcccacgguggacaucgagcucgucaccaccaccguguccaacauggccgaggugcgcagcuacugcuacgaggccuccaucagcgacauggccuccgacagccggugccccacgcagggcgaggccuaccuggacaagcaguccgacacccaguacgucugcaagcgcacccugguggaccggggcugggggaacggcugcgggcuguucggcaaggggagccuggugaccugcgcgaaguucgccugcuccaagaagaugacgggcaagagcauccagcccgagaaccuggaguaccgcaucaugcucuccguccacggcagccagcacuccgggaugaucgugaacgacaccggccacgagaccgacgagaaccgggccaagguggagaucacccccaacagcccgcgcgccgaggcgacgcucgggggcuucggcucccuggggcucgacugcgagccccggaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggucccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgaguccaccgagaacagcaagaugaugcuggagcuggacccgcccuucggcgacuccuacaucgucaucggggugggcgagaagaagaucacccaccacuggcaccggagcggguccacgaucggcaaggccuucgaggcgaccgugcgcggcgccaagcggauggccguccucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5767 - RNA, 1741 nt, Artificial Sequence
  KY003152.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcgccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5768 - RNA, 1741 nt, Artificial Sequence
  KX694533.2 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaucggccacgagaccgacgagaaccgggccaagguggagaucacccccaacuccccgcgcgccgaggcgacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcccacgcgaagcgccagacgguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucaccuucacgaagauccccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgacaagaagaucacccaccacuggcaccgguccgggagcaccaucggcaaggccuucgaggcgacggugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5769 - RNA, 1741 nt, Artificial Sequence
  KX601167.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgacaagaagaucacccaccacugguaccgguccgggagcacgaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5770 - RNA, 1741 nt, Artificial Sequence
  KY288905.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggccacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcacggccgccuucaccuucaccaagguccccgccgagacccugcacgggacggugaccguggagguccaguacgccggcaccgacggccccugcaaggugcccgcgcagauggccguggacaugcagacccugacgccggucgggcgccucaucaccgccaaccccgugaucaccgaguccaccgagaacagcaagaugaugcuggagcuggacccgcccuucggcgacuccuacaucgugaucggggucggcgacaagaagaucacgcaccacuggcaccggagcggguccaccaucggcaaggccuucgaggccaccgugcgcggcgcgaagcggauggccgugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5771 - RNA, 1741 nt, Artificial Sequence
  KF268950.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgccuucacguucaccaagguccccgccgagacccugcacgggaccgugacgguggagguccaguacgccggcaccgacggccccugcaaggugcccgcgcagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgacaagaagaucacccaccacuggcaccggagcggguccacgaucggcaaggccuucgaggccaccgugcgcggcgcgaagcggauggccgugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5772 - RNA, 1741 nt, Artificial Sequence
  KF383116.1 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgucugcacggccgccaaggugcccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggaguccaccgagaacagcaagaugaugcuggagcuggacccgcccuucggcgacuccuacaucgucaucggggugggcgacaagaagaucacccaccacuggcaccggagcggguccaccaucggcaaggccuucgaggcgacggugcgcggcgccaagcggauggccguccucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5773 - RNA, 1723 nt, Artificial Sequence
  KU963574.2 solE mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacagcggcgcggacaccgagaccccgcacuggaacaacaaggaggcccucguggaguucaaggacgcccacgccaagcgccagacggucguggugcuggggagccaggagggcgccguccacaccgcgcuggccggggcccucgaggccgagauggacggcgccaagggccggcuguccagcgggcaccugaagugccgccucaagauggacaagcugcggcugaagggcguguccuacagccucugcaccgcggccuucaccuucacgaagguccccgccgagacccugcacgggaccgugaccguggagguccaguacgccggccgcgacgggcccugcaaggugcccgcccagauggcgguggacaugcagacgcugaccccggucggccggcucaucaccgccaaccccgugaucaccgaguccacggagaacagcaagaugaugcuggagcuggacccgcccuucggcgacuccuacaucgugaucggggucggcgacaagaagaucacccaccacuggcaccgcagcggguccaucaucggcaaggccuucgaggccaccgugcgcggggccaagcggauggcggugcucggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5774 - RNA, 1741 nt, Artificial Sequence
  KF383118.1 solE mRNA Design 2 GC
ggggcgcugccuacggagguggcagccaucuccuucucggcaucaagcuuaccaugagccagaaggugaucuaccuggucaugaucgugcucaucgugcccgccuacuccaucagcugcaucggcgucuccaaccgcgaccugguggaggggaugagcggcgggaccuggguggacgucgugcuggagcacggcgggugcgugaccgagauggcccaggacaagcccacggucgacaucgagcucgugaccaugaccguguccaacauggcggagguccggagcuacugcuacgaggccucccugagcgacauggccuccgccagccgcugccccacccagggcgagcccucccuggacaagcagagcgacacgcaguccgugugcaagcggacccucggcgaccgcggguggggcaacgggugcggcaucuucgggaagggcagccuggugaccugcuccaaguucacgugcugcaagaagaugcccggcaagagcauccagccggagaaccuggaguaccggaucaugcuccccguccacgggucccagcacagcggcaugaucgugaacgacaucgggcacgagaccgacgagaaccgcgccaagguggaggucacccccaacagcccccgggcggaggccacccugggcggcuucgggucccugggccucgacugcgagccgcgcaccgggcuggacuucagcgaccuguacuaccucacgaugaacaacaagcacuggcuggugcacaaggagugguuccacgacaucccccugcccuggcacgccggcgccgacaccgggacgccccacuggaacaacaaggaggcgcucguggaguucaaggacgcccacgccaagcggcagaccgucguggugcugggcucccaggagggcgccguccacaccgcccuggcgggggcccucgaggccgagauggacggcgccaaggggcgccuguucagcggccaccugaagugccggcucaagauggacaagcugcgccugaaggggguguccuacagccucugcaccgccgcguucaccuucaccaaggucccggccgagacgcugcacggcaccgugaccguggagguccaguccgccggcaccgacgggcccugcaaggugcccgcccagauggccguggacaugcagacgcugacccccgucggccggcucaucaccgcgaacccggugaucaccgagagcacggagaacuccaagaugaugcuggagcuggacccgcccuucggggacagcuacaucgugaucggcgucggggacaagaagaucacccaccacuggcaccgcuccggcagcaccaucggcaaggccuucgaggccaccgugcgcggggccaagcggauggccgugcucggcgacacggcgugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5775 - RNA, 1741 nt, Artificial Sequence
  KX520666.1 solE mRNA Design 2 GC
ggggcgcugccuacggagguggcagccaucuccuucucggcaucaagcuuaccaugcgccagaaggugaucuaccuggucaugauccuccugaucgcccccgccuacagcauccggugcaucggcguguccaaccgcgacuucguggaggggaugagcggcgggaccugggucgacguggugcuggagcacggcgggugcgucaccgugauggcgcaggacaagcccacgguggacaucgagcucgucaccaccaccguguccaacauggccgaggugcggagcuacugcuacgaggccuccaucagcgacauggccuccgacagccgcugccccacgcagggcgaggccuaccuggacaagcaguccgacacccaguacgucugcaagcggacccugguggaccgcggcugggggaacggcugcgggcuguucggcaaggggagccuggugaccugcgcgaaguucgccugcuccaagaagaugacgggcaagagcauccagcccgagaaccuggaguaccggaucaugcucuccguccacggcagccagcacuccgggaugaucgugaacgacaccggccacgagaccgacgagaaccgcgccaagguggagaucacccccaacagcccgcgggccgaggcgacgcucgggggcuucggcucccuggggcucgacugcgagccccgcaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcggcagaccguggucgugcuggggucccaggagggcgccgugcacaccgcccuggccggcgcccucgaggcggagauggacggggccaagggccgccugagcagcgggcaccugaagugccggcucaagauggacaagcugcgccugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgaguccaccgagaacagcaagaugaugcuggagcuggacccgcccuucggcgacuccuacaucgucaucggggugggcgagaagaagaucacccaccacuggcaccgcagcggguccacgaucggcaaggccuucgaggcgaccgugcggggcgccaagcgcauggccguccucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5776 - RNA, 1741 nt, Artificial Sequence
  KF383120.1 solE mRNA Design 2 GC
ggggcgcugccuacggagguggcagccaucuccuucucggcaucaagcuuaccaugagccagcgcgugaucuaccuggucaugauccuccugaucgcccccgccuacuccauccggugcaucggcgugagcaaccgcgacuucguggaggggauguccggcgggaccugggucgacguggugcuggagcacggcgggugcgucaccgugauggcgcaggacaagcccacgguggacaucgagcucgucaccaccaccgugagcaacauggccgaggugcgguccuacugcuacgaggccagcaucuccgacauggccagcgacucccgcugccccacgcagggcgaggccuaccuggacaagcagagcgacacccaguacgucugcaagcggacccugguggaccgcggcugggggaacggcugcgggcuguucggcaaggggucccuggugaccugcgcgaaguucacgugcagcaagaagaugaccggcaaguccauccagcccgagaaccuggaguaccggaucaugcucagcguccacggcucccagcacagcgggaugaucgugaacgacaucggccacgagaccgacgagaaccgcgccaagguggaggucacccccaacuccccgcgggccgaggccacgcucgggggcuucggcagccuggggcucgacugcgagccccgcaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcggcagaccgucguggugcuggggagccaggagggcgcgguccacaccgcccuggccggcgcccucgaggccgagauggacggggcgaagggccgccuguucagcgggcaccugaagugccggaucaagauggacaagcuccgccugaagggcguguccuacagccugugcaccgccgccuucacguucuccaagguccccgccgagacccuccacgggaccgugaccguggagguccaguacgccggccgggacggccccugcaaggugcccgcgcagauggccguggacaugcagacgcugaccccggucgggcgccugaucaccgccaaccccaucaucaccgagagcacggagaacucccggaugaugcucgagcuggacccgcccuucggcgacagcuacaucgugaucggggugggcgacaagaagaucacccaccacuggcaccgcuccgggagcaccaucggcaaggccuucgaggccaccguccggggcgcgaagcgcauggccgugcugggggacacggccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5777 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5778 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5779 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5780 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5781 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5782 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5783 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5784 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5785 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5786 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5787 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5788 - RNA, 1741 nt, Artificial Sequence; identical to SEQ ID NO: 5786
  ZIKV (strain NatalRGN) Polyprotein(273-723) mRNA Design 2 opt

SEQ ID NO: 5789 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5790 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5791 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5792 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5793 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5794 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5795 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5796 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5797 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5798 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5799 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5800 - RNA, 2524 nt, Artificial Sequence; identical to SEQ ID NO: 5777
  ZIKV (strain ZikaSPH2015) Polyprotein(93-804) mRNA Design 2 opt

SEQ ID NO: 5801 - RNA, 2521 nt, Artificial Sequence
  ZIKV prME variant mRNA Design 2 opt
ggggcgcugccuacggagguggcagccaucuccuucucggcaucaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5802 - RNA, 2518 nt, Artificial Sequence
  ZIKV prME variant mRNA Design 2 opt
ggggcgcugccuacggagguggcagccaucuccuucucggcaucaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5803 - RNA, 2515 nt, Artificial Sequence
  ZIKV prME variant mRNA Design 2 opt
ggggcgcugccuacggagguggcagccaucuccuucucggcaucaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5804 - RNA, 2512 nt, Artificial Sequence
  ZIKV prME variant mRNA Design 2 opt
ggggcgcugccuacggagguggcagccaucuccuucucggcaucaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5805 - RNA, 2509 nt, Artificial Sequence
  ZIKV prME variant mRNA Design 2 opt
ggggcgcugccuacggagguggcagccaucuccuucucggcaucaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5806 - RNA, 2506 nt, Artificial Sequence
  ZIKV prME variant mRNA Design 2 opt
ggggcgcugccuacggagguggcagccaucuccuucucggcaucaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5807 - RNA, 2503 nt, Artificial Sequence
  ZIKV prME variant mRNA Design 2 opt
ggggcgcugccuacggagguggcagccaucuccuucucggcaucaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5808 - RNA, 2500 nt, Artificial Sequence
  ZIKV prME variant mRNA Design 2 opt
ggggcgcugccuacggagguggcagccaucuccuucucggcaucaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5809 - RNA, 2497 nt, Artificial Sequence
  ZIKV prME variant mRNA Design 2 opt
ggggcgcugccuacggagguggcagccaucuccuucucggcaucaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5810 - RNA, 2494 nt, Artificial Sequence
  ZIKV prME variant mRNA Design 2 opt
ggggcgcugccuacggagguggcagccaucuccuucucggcaucaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5811 - RNA, 2491 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5812 - RNA, 2488 nt, Artificial Sequence
  ZIKV prME variant mRNA Design 2 opt
ggggcgcugccuacggagguggcagccaucuccuucucggcaucaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5813 - RNA, 2485 nt, Artificial Sequence
  ZIKV prME variant mRNA Design 2 opt
ggggcgcugccuacggagguggcagccaucuccuucucggcaucaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5814 - RNA, 2482 nt, Artificial Sequence
  ZIKV prME variant mRNA Design 2 opt
ggggcgcugccuacggagguggcagccaucuccuucucggcaucaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5815 - RNA, 2479 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5816 - RNA, 2479 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5817 - RNA, 2491 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5818 - RNA, 2515 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5819 - RNA, 2515 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5820 - RNA, 2506 nt, Artificial Sequence
  ZIKV prME variant mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5821 - RNA, 2503 nt, Artificial Sequence
  ZIKV prME variant mRNA Design 2 opt
ggggcgcugccuacggagguggcagccaucuccuucucggcaucaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5822 - RNA, 2500 nt, Artificial Sequence
  ZIKV prME variant mRNA Design 2 opt
ggggcgcugccuacggagguggcagccaucuccuucucggcaucaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5823 - RNA, 2497 nt, Artificial Sequence
  ZIKV prME variant mRNA Design 2 opt
ggggcgcugccuacggagguggcagccaucuccuucucggcaucaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5824 - RNA, 2494 nt, Artificial Sequence
  ZIKV prME variant mRNA Design 2 opt
ggggcgcugccuacggagguggcagccaucuccuucucggcaucaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5825 - RNA, 2491 nt, Artificial Sequence
  ZIKV prME variant mRNA Design 2 opt
ggggcgcugccuacggagguggcagccaucuccuucucggcaucaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5826 - RNA, 2488 nt, Artificial Sequence
  ZIKV prME variant mRNA Design 2 opt
ggggcgcugccuacggagguggcagccaucuccuucucggcaucaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5827 - RNA, 2485 nt, Artificial Sequence
  ZIKV prME variant mRNA Design 2 opt
ggggcgcugccuacggagguggcagccaucuccuucucggcaucaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5828 - RNA, 2482 nt, Artificial Sequence
  ZIKV prME variant mRNA Design 2 opt
ggggcgcugccuacggagguggcagccaucuccuucucggcaucaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5829 - RNA, 2479 nt, Artificial Sequence
  ZIKV prME variant mRNA Design 2 opt
ggggcgcugccuacggagguggcagccaucuccuucucggcaucaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5830 - RNA, 2476 nt, Artificial Sequence
  ZIKV prME variant mRNA Design 2 opt
ggggcgcugccuacggagguggcagccaucuccuucucggcaucaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5831 - RNA, 2473 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5832 - RNA, 2470 nt, Artificial Sequence
  ZIKV prME variant mRNA Design 2 opt
ggggcgcugccuacggagguggcagccaucuccuucucggcaucaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5833 - RNA, 2467 nt, Artificial Sequence
  ZIKV prME variant mRNA Design 2 opt
ggggcgcugccuacggagguggcagccaucuccuucucggcaucaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5834 - RNA, 2464 nt, Artificial Sequence
  ZIKV prME variant mRNA Design 2 opt
ggggcgcugccuacggagguggcagccaucuccuucucggcaucaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5835 - RNA, 2461 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5836 - RNA, 2461 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5837 - RNA, 2473 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5838 - RNA, 2497 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5839 - RNA, 2497 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5840 - RNA, 2497 nt, Artificial Sequence
  ZIKV prME variant mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5841 - RNA, 2494 nt, Artificial Sequence
  ZIKV prME variant mRNA Design 2 opt
ggggcgcugccuacggagguggcagccaucuccuucucggcaucaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5842 - RNA, 2491 nt, Artificial Sequence
  ZIKV prME variant mRNA Design 2 opt
ggggcgcugccuacggagguggcagccaucuccuucucggcaucaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5843 - RNA, 2488 nt, Artificial Sequence
  ZIKV prME variant mRNA Design 2 opt
ggggcgcugccuacggagguggcagccaucuccuucucggcaucaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5844 - RNA, 2485 nt, Artificial Sequence
  ZIKV prME variant mRNA Design 2 opt
ggggcgcugccuacggagguggcagccaucuccuucucggcaucaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5845 - RNA, 2482 nt, Artificial Sequence
  ZIKV prME variant mRNA Design 2 opt
ggggcgcugccuacggagguggcagccaucuccuucucggcaucaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5846 - RNA, 2479 nt, Artificial Sequence
  ZIKV prME variant mRNA Design 2 opt
ggggcgcugccuacggagguggcagccaucuccuucucggcaucaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5847 - RNA, 2476 nt, Artificial Sequence
  ZIKV prME variant mRNA Design 2 opt
ggggcgcugccuacggagguggcagccaucuccuucucggcaucaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5848 - RNA, 2473 nt, Artificial Sequence
  ZIKV prME variant mRNA Design 2 opt
ggggcgcugccuacggagguggcagccaucuccuucucggcaucaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5849 - RNA, 2470 nt, Artificial Sequence
  ZIKV prME variant mRNA Design 2 opt
ggggcgcugccuacggagguggcagccaucuccuucucggcaucaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5850 - RNA, 2467 nt, Artificial Sequence
  ZIKV prME variant mRNA Design 2 opt
ggggcgcugccuacggagguggcagccaucuccuucucggcaucaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5851 - RNA, 2464 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5852 - RNA, 2461 nt, Artificial Sequence
  ZIKV prME variant mRNA Design 2 opt
ggggcgcugccuacggagguggcagccaucuccuucucggcaucaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5853 - RNA, 2458 nt, Artificial Sequence
  ZIKV prME variant mRNA Design 2 opt
ggggcgcugccuacggagguggcagccaucuccuucucggcaucaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5854 - RNA, 2455 nt, Artificial Sequence
  ZIKV prME variant mRNA Design 2 opt
ggggcgcugccuacggagguggcagccaucuccuucucggcaucaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5855 - RNA, 2452 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5856 - RNA, 2452 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5857 - RNA, 2464 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5858 - RNA, 2488 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5859 - RNA, 2488 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5860 - RNA, 2494 nt, Artificial Sequence
  ZIKV prME variant mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5861 - RNA, 2488 nt, Artificial Sequence
  ZIKV prME variant mRNA Design 2 opt
ggggcgcugccuacggagguggcagccaucuccuucucggcaucaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5862 - RNA, 2491 nt, Artificial Sequence
  ZIKV prME variant mRNA Design 2 opt
ggggcgcugccuacggagguggcagccaucuccuucucggcaucaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5863 - RNA, 2485 nt, Artificial Sequence
  ZIKV prME variant mRNA Design 2 opt
ggggcgcugccuacggagguggcagccaucuccuucucggcaucaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5864 - RNA, 2482 nt, Artificial Sequence
  ZIKV prME variant mRNA Design 2 opt
ggggcgcugccuacggagguggcagccaucuccuucucggcaucaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5865 - RNA, 2479 nt, Artificial Sequence
  ZIKV prME variant mRNA Design 2 opt
ggggcgcugccuacggagguggcagccaucuccuucucggcaucaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5866 - RNA, 2476 nt, Artificial Sequence
  ZIKV prME variant mRNA Design 2 opt
ggggcgcugccuacggagguggcagccaucuccuucucggcaucaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5867 - RNA, 2473 nt, Artificial Sequence
  ZIKV prME variant mRNA Design 2 opt
ggggcgcugccuacggagguggcagccaucuccuucucggcaucaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5868 - RNA, 2470 nt, Artificial Sequence
  ZIKV prME variant mRNA Design 2 opt
ggggcgcugccuacggagguggcagccaucuccuucucggcaucaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5869 - RNA, 2467 nt, Artificial Sequence
  ZIKV prME variant mRNA Design 2 opt
ggggcgcugccuacggagguggcagccaucuccuucucggcaucaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5870 - RNA, 2464 nt, Artificial Sequence
  ZIKV prME variant mRNA Design 2 opt
ggggcgcugccuacggagguggcagccaucuccuucucggcaucaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5871 - RNA, 2461 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5872 - RNA, 2458 nt, Artificial Sequence
  ZIKV prME variant mRNA Design 2 opt
ggggcgcugccuacggagguggcagccaucuccuucucggcaucaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5873 - RNA, 2455 nt, Artificial Sequence
  ZIKV prME variant mRNA Design 2 opt
ggggcgcugccuacggagguggcagccaucuccuucucggcaucaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5874 - RNA, 2452 nt, Artificial Sequence
  ZIKV prME variant mRNA Design 2 opt
ggggcgcugccuacggagguggcagccaucuccuucucggcaucaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5875 - RNA, 2449 nt, Artificial Sequence; identical to SEQ ID NO: 5781
  ZIKV (strain ZikaSPH2015) Polyprotein(108-794) mRNA Design 2 opt

SEQ ID NO: 5876 - RNA, 2449 nt, Artificial Sequence
  ZIKV prME variant mRNA Design 2 opt
ggggcgcugccuacggagguggcagccaucuccuucucggcaucaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5877 - RNA, 2461 nt, Artificial Sequence
  ZIKV prME variant mRNA Design 2 opt
ggggcgcugccuacggagguggcagccaucuccuucucggcaucaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5878 - RNA, 2485 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5879 - RNA, 2485 nt, Artificial Sequence
  ZIKV prME variant mRNA Design 2 opt
ggggcgcugccuacggagguggcagccaucuccuucucggcaucaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5880 - RNA, 2524 nt, Artificial Sequence; identical to SEQ ID NO: 5777
  KU321639.1 prME-long mRNA Design 2 opt

SEQ ID NO: 5881 - RNA, 2524 nt, Artificial Sequence; identical to SEQ ID NO: 5778
  KU312312.1 prME-long mRNA Design 2 opt

SEQ ID NO: 5882 - RNA, 2512 nt, Artificial Sequence; identical to SEQ ID NO: 5779
  AY632535.2 prME-long mRNA Design 2 opt

SEQ ID NO: 5883 - RNA, 2524 nt, Artificial Sequence; identical to SEQ ID NO: 5780
  KU527068.1 prME-long mRNA Design 2 opt

SEQ ID NO: 5884 - RNA, 2524 nt, Artificial Sequence
  KU720415.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5885 - RNA, 2506 nt, Artificial Sequence
  DQ859059.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5886 - RNA, 2524 nt, Artificial Sequence
  KX377335.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5887 - RNA, 2524 nt, Artificial Sequence
  LC002520.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5888 - RNA, 2512 nt, Artificial Sequence
  KU963573.2 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5889 - RNA, 2524 nt, Artificial Sequence
  KX694534.2 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5890 - RNA, 2524 nt, Artificial Sequence
  KX447520.1 prME-long mRNA Design 2 opt
ggggcgcugccuacggagguggcagccaucuccuucucggcaucaagcuuaccaugcgcaucaucaacgcccgcaaggagaagaagcgccgcggcgccgacgccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5891 - RNA, 2524 nt, Artificial Sequence
  KX369547.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5892 - RNA, 2524 nt, Artificial Sequence
  KX447515.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5893 - RNA, 2524 nt, Artificial Sequence
  KU501217.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5894 - RNA, 2524 nt, Artificial Sequence
  KU312314.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5895 - RNA, 2524 nt, Artificial Sequence
  KX446950.2 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5896 - RNA, 2524 nt, Artificial Sequence
  KY003157.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5897 - RNA, 2524 nt, Artificial Sequence
  KX811222.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5898 - RNA, 2524 nt, Artificial Sequence
  KX447516.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5899 - RNA, 2524 nt, Artificial Sequence
  KX520666.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5900 - RNA, 2524 nt, Artificial Sequence
  KU729218.1 prME-long mRNA Design 2 opt
ggggcgcugccuacggagguggcagccaucuccuucucggcaucaagcuuaccaugcgcaucaucaacgcccgcaaggagaagaagcgccgcuccgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5901 - RNA, 2524 nt, Artificial Sequence
  KU761561.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5902 - RNA, 2524 nt, Artificial Sequence
  KY317938.1 prME-long mRNA Design 2 opt
ggggcgcugccuacggagguggcagccaucuccuucucggcaucaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5903 - RNA, 2524 nt, Artificial Sequence
  KY075939.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5904 - RNA, 2524 nt, Artificial Sequence
  KX806557.2 prME-long mRNA Design 2 opt
ggggcgcugccuacggagguggcagccaucuccuucucggcaucaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5905 - RNA, 2524 nt, Artificial Sequence
  KU870645.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5906 - RNA, 2524 nt, Artificial Sequence
  KU729217.2 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5907 - RNA, 2524 nt, Artificial Sequence
  KU497555.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5908 - RNA, 2524 nt, Artificial Sequence
  KX087101.3 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5909 - RNA, 2524 nt, Artificial Sequence
  KY075932.1 prME-long mRNA Design 2 opt
ggggcgcugccuacggagguggcagccaucuccuucucggcaucaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5910 - RNA, 2524 nt, Artificial Sequence
  KY014317.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5911 - RNA, 2524 nt, Artificial Sequence
  KU758876.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5912 - RNA, 2524 nt, Artificial Sequence
  KU758874.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5913 - RNA, 2524 nt, Artificial Sequence
  KY014314.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5914 - RNA, 2524 nt, Artificial Sequence
  KU926310.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5915 - RNA, 2524 nt, Artificial Sequence
  KU761560.1 prME-long mRNA Design 2 opt
ggggcgcugccuacggagguggcagccaucuccuucucggcaucaagcuuaccaugcgcaucaucaacgccggcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5916 - RNA, 2524 nt, Artificial Sequence
  KY317939.1 prME-long mRNA Design 2 opt
ggggcgcugccuacggagguggcagccaucuccuucucggcaucaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5917 - RNA, 2524 nt, Artificial Sequence
  KY075937.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5918 - RNA, 2524 nt, Artificial Sequence
  LC191864.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5919 - RNA, 2524 nt, Artificial Sequence
  KX447517.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5920 - RNA, 2524 nt, Artificial Sequence
  KU922923.1 prME-long mRNA Design 2 opt
ggggcgcugccuacggagguggcagccaucuccuucucggcaucaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5921 - RNA, 2524 nt, Artificial Sequence
  KY003156.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5922 - RNA, 2524 nt, Artificial Sequence
  KU312313.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5923 - RNA, 2524 nt, Artificial Sequence
  KY075935.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5924 - RNA, 2524 nt, Artificial Sequence
  KY014320.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5925 - RNA, 2524 nt, Artificial Sequence
  KX827309.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5926 - RNA, 2524 nt, Artificial Sequence
  KU681081.3 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5927 - RNA, 2524 nt, Artificial Sequence
  KU744693.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcggcgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5928 - RNA, 2524 nt, Artificial Sequence
  KY328290.1 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5929 - RNA, 2524 nt, Artificial Sequence
  KX694532.2 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5930 - RNA, 2524 nt, Artificial Sequence
  KU955593.1 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5931 - RNA, 2524 nt, Artificial Sequence
  KY272987.1 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5932 - RNA, 2524 nt, Artificial Sequence
  EU545988.1 prME-long mRNA Design 2 opt
ggggcgcugccuacggagguggcagccaucuccuucucggcaucaagcuuaccaugcgcaucaucaacgcccgcaaggagaagaagcgccgcggcaccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5933 - RNA, 2524 nt, Artificial Sequence
  KU681082.3 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5934 - RNA, 2524 nt, Artificial Sequence
  KX601167.1 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5935 - RNA, 2524 nt, Artificial Sequence
  KX694533.2 prME-long mRNA Design 2 opt
ggggcgcugccuacggagguggcagccaucuccuucucggcaucaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5936 - RNA, 2524 nt, Artificial Sequence
  KY288905.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5937 - RNA, 2524 nt, Artificial Sequence
  KF268950.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5938 - RNA, 2524 nt, Artificial Sequence
  KF383121.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5939 - RNA, 2506 nt, Artificial Sequence
  KF268949.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5940 - RNA, 2524 nt, Artificial Sequence
  KU955595.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5941 - RNA, 2524 nt, Artificial Sequence
  KF383116.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5942 - RNA, 2506 nt, Artificial Sequence
  KU963574.2 prME-long mRNA Design 2 opt
ggggcgcugccuacggagguggcagccaucuccuucucggcaucaagcuuaccaugcgcaucaucaacgcccgcaaggagcgcaagcgccgcggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5943 - RNA, 2506 nt, Artificial Sequence
  KX601166.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5944 - RNA, 2524 nt, Artificial Sequence
  KF383118.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5945 - RNA, 2518 nt, Artificial Sequence
  KF383120.1 prME-long mRNA Design 2 opt
ggggcgcugccuacggagguggcagccaucuccuucucggcaucaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccgacgucggcugcuccgucgacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5946 - RNA, 2449 nt, Artificial Sequence; identical to SEQ ID NO: 5781
  KU321639.1 prME-short mRNA Design 2 opt

SEQ ID NO: 5947 - RNA, 2449 nt, Artificial Sequence; identical to SEQ ID NO: 5782
  KU312312.1 prME-short mRNA Design 2 opt

SEQ ID NO: 5948 - RNA, 2437 nt, Artificial Sequence; identical to SEQ ID NO: 5783
  AY632535.2 prME-short mRNA Design 2 opt

SEQ ID NO: 5949 - RNA, 2449 nt, Artificial Sequence; identical to SEQ ID NO: 5784
  KU527068.1 prME-short mRNA Design 2 opt

SEQ ID NO: 5950 - RNA, 2449 nt, Artificial Sequence
  KX421193.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5951 - RNA, 2449 nt, Artificial Sequence
  KX377335.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5952 - RNA, 2449 nt, Artificial Sequence
  LC002520.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5953 - RNA, 2431 nt, Artificial Sequence
  DQ859059.1 prME-short mRNA Design 2 opt
ggggcgcugccuacggagguggcagccaucuccuucucggcaucaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5954 - RNA, 2437 nt, Artificial Sequence
  KU963573.2 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5955 - RNA, 2449 nt, Artificial Sequence
  KX694534.2 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5956 - RNA, 2449 nt, Artificial Sequence
  KX369547.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5957 - RNA, 2449 nt, Artificial Sequence
  KX447515.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5958 - RNA, 2449 nt, Artificial Sequence
  KU729218.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5959 - RNA, 2449 nt, Artificial Sequence
  KU501217.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5960 - RNA, 2449 nt, Artificial Sequence
  KU312314.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5961 - RNA, 2449 nt, Artificial Sequence
  KX446950.2 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5962 - RNA, 2449 nt, Artificial Sequence
  KY003157.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5963 - RNA, 2449 nt, Artificial Sequence
  KX811222.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5964 - RNA, 2449 nt, Artificial Sequence
  KX447516.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5965 - RNA, 2449 nt, Artificial Sequence
  KX520666.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5966 - RNA, 2449 nt, Artificial Sequence
  KU497555.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5967 - RNA, 2449 nt, Artificial Sequence
  KY075939.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5968 - RNA, 2449 nt, Artificial Sequence
  KY075932.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5969 - RNA, 2449 nt, Artificial Sequence
  KU870645.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5970 - RNA, 2449 nt, Artificial Sequence
  KU729217.2 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5971 - RNA, 2449 nt, Artificial Sequence
  KX087101.3 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5972 - RNA, 2449 nt, Artificial Sequence
  KY014317.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5973 - RNA, 2449 nt, Artificial Sequence
  KU758876.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5974 - RNA, 2449 nt, Artificial Sequence
  KU758874.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5975 - RNA, 2449 nt, Artificial Sequence
  KY317939.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5976 - RNA, 2449 nt, Artificial Sequence
  KY014314.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5977 - RNA, 2449 nt, Artificial Sequence
  KX447517.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5978 - RNA, 2449 nt, Artificial Sequence
  KU926310.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5979 - RNA, 2449 nt, Artificial Sequence
  KU922923.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5980 - RNA, 2449 nt, Artificial Sequence
  KY075937.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5981 - RNA, 2449 nt, Artificial Sequence
  KY003156.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5982 - RNA, 2449 nt, Artificial Sequence
  KU312313.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5983 - RNA, 2449 nt, Artificial Sequence
  KY075935.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5984 - RNA, 2449 nt, Artificial Sequence
  KY014320.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5985 - RNA, 2449 nt, Artificial Sequence
  KY328290.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5986 - RNA, 2449 nt, Artificial Sequence
  KU681081.3 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5987 - RNA, 2449 nt, Artificial Sequence
  KX827309.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5988 - RNA, 2449 nt, Artificial Sequence
  KU955593.1 prME-short mRNA Design 2 opt
ggggcgcugccuacggagguggcagccaucuccuucucggcaucaagcuuaccaugaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5989 - RNA, 2449 nt, Artificial Sequence
  KY272987.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5990 - RNA, 2449 nt, Artificial Sequence
  KY007221.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5991 - RNA, 2449 nt, Artificial Sequence
  EU545988.1 prME-short mRNA Design 2 opt
ggggcgcugccuacggagguggcagccaucuccuucucggcaucaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5992 - RNA, 2449 nt, Artificial Sequence
  KU681082.3 prME-short mRNA Design 2 opt
ggggcgcugccuacggagguggcagccaucuccuucucggcaucaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5993 - RNA, 2449 nt, Artificial Sequence
  KX601167.1 prME-short mRNA Design 2 opt
ggggcgcugccuacggagguggcagccaucuccuucucggcaucaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5994 - RNA, 2449 nt, Artificial Sequence
  KX694533.2 prME-short mRNA Design 2 opt
ggggcgcugccuacggagguggcagccaucuccuucucggcaucaagcuuaccaugaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5995 - RNA, 2449 nt, Artificial Sequence
  KY288905.1 prME-short mRNA Design 2 opt
ggggcgcugccuacggagguggcagccaucuccuucucggcaucaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5996 - RNA, 2449 nt, Artificial Sequence
  KF268950.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5997 - RNA, 2449 nt, Artificial Sequence
  KF383121.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5998 - RNA, 2431 nt, Artificial Sequence
  KF268949.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5999 - RNA, 2449 nt, Artificial Sequence
  KU955595.1 prME-short mRNA Design 2 opt
ggggcgcugccuacggagguggcagccaucuccuucucggcaucaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6000 - RNA, 2449 nt, Artificial Sequence
  KF383116.1 prME-short mRNA Design 2 opt
ggggcgcugccuacggagguggcagccaucuccuucucggcaucaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6001 - RNA, 2431 nt, Artificial Sequence
  KX601166.1 prME-short mRNA Design 2 opt
ggggcgcugccuacggagguggcagccaucuccuucucggcaucaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6002 - RNA, 2449 nt, Artificial Sequence
  KF383118.1 prME-short mRNA Design 2 opt
ggggcgcugccuacggagguggcagccaucuccuucucggcaucaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6003 - RNA, 2446 nt, Artificial Sequence
  KX447520.1 prME-short mRNA Design 2 opt
ggggcgcugccuacggagguggcagccaucuccuucucggcaucaagcuuaccauguccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6004 - RNA, 2449 nt, Artificial Sequence
  KU761561.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6005 - RNA, 2449 nt, Artificial Sequence
  KX806557.2 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6006 - RNA, 2449 nt, Artificial Sequence
  LC191864.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6007 - RNA, 2449 nt, Artificial Sequence
  KU744693.1 prME-short mRNA Design 2 opt
ggggcgcugccuacggagguggcagccaucuccuucucggcaucaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6008 - RNA, 2440 nt, Artificial Sequence
  KU963574.2 prME-short mRNA Design 2 opt
ggggcgcugccuacggagguggcagccaucuccuucucggcaucaagcuuaccaugggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6009 - RNA, 2458 nt, Artificial Sequence
  KF383120.1 prME-short mRNA Design 2 opt
ggggcgcugccuacggagguggcagccaucuccuucucggcaucaagcuuaccaugggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6010 - RNA, 1741 nt, Artificial Sequence; identical to SEQ ID NO: 5785
  KU321639.1 solE mRNA Design 2 opt

SEQ ID NO: 6011 - RNA, 1741 nt, Artificial Sequence; identical to SEQ ID NO: 5786
  KU312312.1 solE mRNA Design 2 opt

SEQ ID NO: 6012 - RNA, 1729 nt, Artificial Sequence; identical to SEQ ID NO: 5787
  AY632535.2 solE mRNA Design 2 opt

SEQ ID NO: 6013 - RNA, 1741 nt, Artificial Sequence; identical to SEQ ID NO: 5786
  KU527068.1 solE mRNA Design 2 opt

SEQ ID NO: 6014 - RNA, 1741 nt, Artificial Sequence
  KX421193.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6015 - RNA, 1741 nt, Artificial Sequence
  LC002520.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6016 - RNA, 1723 nt, Artificial Sequence
  DQ859059.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6017 - RNA, 1729 nt, Artificial Sequence
  KU963573.2 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6018 - RNA, 1741 nt, Artificial Sequence
  KY075939.1 solE mRNA Design 2 opt
ggggcgcugccuacggagguggcagccaucuccuucucggcaucaagcuuaccaugucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6019 - RNA, 1741 nt, Artificial Sequence
  KX447516.1 solE mRNA Design 2 opt
ggggcgcugccuacggagguggcagccaucuccuucucggcaucaagcuuaccauguccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6020 - RNA, 1741 nt, Artificial Sequence
  KX447515.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6021 - RNA, 1741 nt, Artificial Sequence
  KU758874.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6022 - RNA, 1741 nt, Artificial Sequence
  KU729218.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6023 - RNA, 1741 nt, Artificial Sequence
  KU501217.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6024 - RNA, 1741 nt, Artificial Sequence
  KU761561.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6025 - RNA, 1741 nt, Artificial Sequence
  KY075937.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6026 - RNA, 1741 nt, Artificial Sequence
  KY014317.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6027 - RNA, 1741 nt, Artificial Sequence
  KU870645.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6028 - RNA, 1741 nt, Artificial Sequence
  KU922923.1 solE mRNA Design 2 opt
ggggcgcugccuacggagguggcagccaucuccuucucggcaucaagcuuaccaugucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6029 - RNA, 1741 nt, Artificial Sequence
  KU497555.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6030 - RNA, 1741 nt, Artificial Sequence
  KU312314.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6031 - RNA, 1741 nt, Artificial Sequence
  KY014314.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6032 - RNA, 1741 nt, Artificial Sequence
  KX447517.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6033 - RNA, 1741 nt, Artificial Sequence
  KU729217.2 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6034 - RNA, 1741 nt, Artificial Sequence
  KY328290.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6035 - RNA, 1741 nt, Artificial Sequence
  KX087101.3 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6036 - RNA, 1741 nt, Artificial Sequence
  KY003156.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6037 - RNA, 1741 nt, Artificial Sequence
  KU758876.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6038 - RNA, 1741 nt, Artificial Sequence
  KU926310.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6039 - RNA, 1741 nt, Artificial Sequence
  KU681081.3 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6040 - RNA, 1741 nt, Artificial Sequence
  KU744693.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6041 - RNA, 1741 nt, Artificial Sequence
  EU545988.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6042 - RNA, 1741 nt, Artificial Sequence
  KY007221.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6043 - RNA, 1741 nt, Artificial Sequence
  KY003152.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcgccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6044 - RNA, 1741 nt, Artificial Sequence
  KX694533.2 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6045 - RNA, 1741 nt, Artificial Sequence
  KX601167.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6046 - RNA, 1741 nt, Artificial Sequence
  KY288905.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6047 - RNA, 1741 nt, Artificial Sequence
  KF268950.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6048 - RNA, 1741 nt, Artificial Sequence
  KF383116.1 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6049 - RNA, 1723 nt, Artificial Sequence
  KU963574.2 solE mRNA Design 2 opt
ggggcgcugccuacggagguggcagccaucuccuucucggcaucaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6050 - RNA, 1741 nt, Artificial Sequence
  KF383118.1 solE mRNA Design 2 opt
ggggcgcugccuacggagguggcagccaucuccuucucggcaucaagcuuaccaugucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6051 - RNA, 1741 nt, Artificial Sequence
  KX520666.1 solE mRNA Design 2 opt
ggggcgcugccuacggagguggcagccaucuccuucucggcaucaagcuuaccaugcgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6052 - RNA, 1741 nt, Artificial Sequence
  KF383120.1 solE mRNA Design 2 opt
ggggcgcugccuacggagguggcagccaucuccuucucggcaucaagcuuaccaugucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6053 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6054 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaaugcaaagaacgguagcauauccuugaugugucucgccuuagggggaguucugaucuuccugucaacggcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6055 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugaggaccgagcaaaggucgaggugacaccuaauucaccacgcgcugaagccacucuugggggauucggcagucuggguuuggauugugagcccagaaccgggcucgacuuuagcgaucuguauuacuuaacaaugaacaauaaacacuggcugguacauaaggaaugguuccacgacauaccucucccauggcacgcuggcgccgauacuggaaccccgcauuggaacaauaaagaggcacuuguugaauuuaaggacgcccacgcuaagaggcagacaguggucgugcugggcucccaggagggggcgguccauaccgcauuggccggagcucuagaggccgaaauggauggugcaaaaggccggcuguucucugggcaccucaagugccgccugaaaauggacaaacuuagacugaagggagugagcuauucauuguguacugccgcuuuuacguucacaaagguucccgccgagacccuccauggcacugugaccguagaaguccaguacgcagguacagacgggccuugcaagaucccagugcaaauggcgguugauaugcagacccugacucccgugggcagguuaauuacagcuaacccugucaucacggagaguaccgaaaauuccaaaaugaugcuggagcuagacccacccuuuggagauagcuacauagugauuggcguaggggacaagaaaaucacucaccacuggcaucguucuggaucaacaaucgguaaggccuucgaggcaaccgugcggggcgccaaacgaauggcuguucucggggauacagccugggacuucggaagugucggcgguguguuuaacagccuggggaagggcauucaccagaucuucggagcagcuuuuaagucccuuuucggcgggaugucuugguuuucgcaaauuuugauaggaacucugcucguguggcugggccuuaacaccaaaaaugguagcaucucccugacguguuuggcccucgggggagucaugauuuuccugucaaccgcgguuagugccgaugugggcugcucuguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6056 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6057 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6058 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacgccaagaauggcagcaucuccuugaugugucucgcucugggugggguuuuaauuuuccugucaacggcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6059 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacaauuggaaaggcguucgaggcuaccgugcggggugccaaacgcauggcaguucucggcgacacagccugggauuucgggagugucggaggcguguuuaauagccuggguaaggggauccaccagaucuucggcgcugccuuuaaaucccuuuucggaggcaugucuugguuuucgcaaauuuugaucgggacucugcucguguggcugggacuuaacaccaagaacggcagcauuucccugacguguuuggcacucgguggggucaugauauuccugucaaccgcuguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6060 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6061 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagauaucgugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6062 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgaaacggauggcaguucugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6063 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugaggacagggccaagguggaagucacgcccaacaguccucgggcugaggcaacucugggaggguuuggcagcuugggucucgauugcgagccacgcaccgggcuggacuucucugaucuguacuaccucacaaugaauaacaaacauugguuaguucacaaggaaugguuucaugacauuccccugccuuggcacgccggagcugacacuggcaccccacacuggaauaacaaagaggcccuuguggaguucaaggaugcgcaugcaaagagacagacaguaguggucuugggcucccaggaaggggccgugcacaccgcucuggccggagcacuagaagcugagauggacggugccaaaggcaggcucuuuucagggcaucugaagugucggcuuaaaauggauaagcugcgcuugaaaggaguuagcuauagucucugcacggcggccuucacuuuuacaaaggugcccgcagagacccugcacggcacugucacaguggaaguacaauacgcugguaccgacgggccuuguaaaaucccaguucagauggccguggauaugcagacguuaaccccggucggccgacugauuacagcuaaucccgugaucacugagucuaccgaaaacuccaagaugaugcucgagcuugacccuccauucggagauagcuauauagucauuggcgugggggacaagaaaaucacacaccauuggcacagaucgggaucuacuauugguaaggccuuugaagcaaccguuaggggcgccaaacggauggcugugcugggggauacagcgugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6064 - RNA, 1741 nt, Artificial Sequence; identical to SEQ ID NO: 6062
  ZIKV (strain NatalRGN) Polyprotein(273-723) mRNA Design 2 opt

SEQ ID NO: 6065 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcugaguggaaagggcucucuagucacaugcgcgaaauucgccugcuccaagaaaaugaccggcaagagcauucagccugaaaaccucgaguaccguaucaugcugucggugcacgggucucaacacuccggaaugauuguuaaugacacgggucaugaaaccgaugagaaccgcgcaaagguggagaucacaccaaauucacccagagcugaagccacucuuggcggguuuggaagucugggcuuggacugugagccuaggaccggucucgauuucagcgaccuguauuacuuaacaaugaacaauaaacacuggcugguccauaaggaaugguuucacgauaucccacucccguggcacgcuggggccgacacuggcaccccucauuggaacaauaaagaggcacuuguggaguucaaggaugcccacgcuaaacggcagacaguaguugugcugggaucccaggaaggcgcgguccauaccgcauuggccggggcucuagaggccgaaauggacggagcaaagggucgacugucuagcggccaccucaaaugccgccugaagauggauaagcugagacugaaaggggugucauauaguuuguguacugccgcuuuuacguucacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggaguccaccgaaaacagcaagaugaugcuggagcuagaucccccguuuggcgacucuuacauuguuaucggagugggcgagaaaaagauaacucaccacuggcaucggucagggaguacaauuggaaaggcauucgaagccaccguccgcggugcuaaaagaauggccgugcucggcgauacagcaugggacuuugggagcguaggaggcgcucuuaauucccuugguaaggggauccaccagaucuucggcgccgcguucaaaucuuuguuuggaggcaugucgugguucagccaaauucugaucgggacucuccugauguggcuuggacugaacaccaagaauggcuccauuucauugaugugucucgcccugggugggguguuaauauuucugaguacggcuguuucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6066 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcugaguggaaagggcucucuagugaccugcgcgaaauucgccugcuccaagaaaaugacgggcaagagcauacagccugaaaaccucgaguaccguauuaugcugucgguucacgggucucaacacuccggaaugaucgugaaugacaccggucaugaaacagaugagaaccgcgcaaaggucgagauuacuccaaauucacccagagcugaagccacccuuggcggguuuggaagucugggcuuggacugugagccuaggacaggucucgauuucagcgaccuguauuacuuaacuaugaacaauaaacacuggcuggugcauaaggaaugguuucacgauaucccacucccguggcacgcuggggccgacaccggcacaccccauuggaacaauaaagaggcacuuguagaguucaaggaugcccacgcuaaacggcagaccguugugguccugggaucccaggaaggcgcggugcauacugcauuggccggggcucuagaggccgaaauggacggagcaaagggucgacugucuagcggccaccucaaaugccgccugaagauggauaagcugagacugaaaggggucucauauaguuuguguacggccgcuuuuacauucaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgaguccacugaaaacagcaagaugaugcuggagcuagaucccccguuuggcgacucuuacaucgugauuggagucggcgagaaaaagaucacacaccacuggcaucggucagggaguaccauaggaaaggcauucgaagccacagugcgcggugcuaaaagaauggccguacucggcgauacugcaugggacuuugggagcgugggaggcgcucuuaauucccuugguaaggggauucaccagaucuucggcgccgcguucaaaucuuuguuuggaggcaugucgugguucagccaaauccugauugggacccuccugauguggcuuggacugaacgccaagaauggcuccaucucauugaugugucucgcucugggugggguuuuaauuuuucugaguacggcagucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6067 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcugucuggaaagggcucccuaguuacaugcgccaaauuuaccugcagcaagaagaugacgggcaaaucgauccagcccgaaaaucucgaauaucggauuaugcugucugugcacgggucccaacauucaggaaugaucgguuacgagaccgacgaagaucgugcgaaggucgaggugacaccuaacaguccacgcgccgaggcaacucuuggcggguucggaagccugggcuuggacugugaacccagaaccggucucgauuucuccgaccuguauuacuuaacaaugaauaacaaacacuggcugguacauaaggagugguuucacgauaucccucucccauggcacgcuggggccgacacuggcaccccgcauuggaauaacaaagaagcucuuguugaguucaaggaugcccacgcaaaaaggcagacaguggucgugcugggaucucaggaaggcgccguccauaccgcuuuggcgggggcacuagaggccgagauggacggagcuaagggucggcuguuuagcggccaccucaagugccgacugaaaauggauaaacuucgccugaagggggugucauauaguuuguguacugccgcauucacguuuacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaauccaccgagaacagcaagaugaugcuggaacuagauccacccuucggcgacucuuacauugugaucggaguaggcgauaagaaaauaacucaccacuggcauaggucagggaguacaauuggaaaggcguuugaggcuaccgugcggggugccaaacgcauggcaguucucggcgacacagccugggauuucgggagcgucggaggcguguucaauucccuggguaaggggauccaccagaucuuuggcgcugccuucaaaucucuuuuuggaggcaugucgugguucagccaaauuuugaucgggacucugcucguguggcugggacuuaacaccaagaacggcuccauuucacugacguguuuggcacucgguggggucaugauauuucugaguaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6068 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcugaguggaaagggcucucuagugacaugcgcgaaauucgccugcuccaagaaaaugaccggcaagagcauacagccugaaaaccucgaguaccguauuaugcugucgguucacgggucucaacacuccggaaugaucgugaaugacacgggucaugaaaccgaugagaaccgcgcaaaggucgagauuacaccaaauucacccagagcugaagccacucuuggcggguuuggaagucugggcuuggacugugagccuaggaccggucucgauuucagcgaccuguauuacuuaacaaugaacaauaaacacuggcuggugcauaaggaaugguuucacgauaucccacucccguggcacgcuggggccgacacuggcaccccucauuggaacaauaaagaggcacuuguagaguucaaggaugcccacgcuaaacggcagacaguugugguccugggaucccaggaaggcgcggugcauaccgcauuggccggggcucuagaggccgaaauggacggagcaaagggucgacugucuagcggccaccucaaaugccgccugaagauggauaagcugagacugaaaggggucucauauaguuuguguacugccgcuuuuacguucacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggaguccaccgaaaacagcaagaugaugcuggagcuagaucccccguuuggcgacucuuacaucgugauuggagucggcgagaaaaagaucacucaccacuggcaucggucagggaguacaauaggaaaggcauucgaagccaccgugcgcggugcuaaaagaauggccguacucggcgauacagcaugggacuuugggagcgugggaggcgcucuuaauucccuugguaaggggauucaccagaucuucggcgccgcguucaaaucuuuguuuggaggcaugucgugguucagccaaauccugauugggacucuccugauguggcuuggacugaacaccaagaauggcuccaucucauugaugugucucgcccugggugggguuuuaauuuuucugaguacggcugucucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6069 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguucaggacacgggucaugaaaccgaugagaaucgcgcaaagguggagaucacaccaaacucccccagagcugaagccacucuuggcggguucggaucacugggcuuggacugugagccuaggaccggucucgauuuuagugaccuguauuacuuaacaaugaauaacaaacacuggcugguccauaaggaaugguuccacgauaucccacucccguggcacgcuggggccgacacuggcaccccucauuggaauaacaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaauacgcaggcacagacgguccaugcaaagugcccgcgcagauggcuguagacaugcagacccugacuccugucgggagguuaauaacagccaauccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaacagccuugguaaggggauccaccaaaucuucggcgccgcguuuaaauccuuguucggaggcaugucuugguuuucgcagauucugaucgggacucuccugauguggcuuggacugaauaccaagaacggcagcauuuccuugaugugucucgcccugggugggguguuaauauuccugucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6070 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugcaggacaccggucaugaaacagaugagaaucgcgcaaaggucgagauuacuccaaacucccccagagcugaagccacccuuggcggguucggaucacugggcuuggacugugagccuaggacaggucucgauuuuagugaccuguauuacuuaacuaugaauaacaaacacuggcuggugcauaaggaaugguuccacgauaucccacucccguggcacgcuggggccgacaccggcacaccccauuggaauaacaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaauacgcaggcaccgacgguccaugcaaaguacccgcgcagauggcugucgacaugcagacucugacaccuguggggagguuaauuacggccaauccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaacagccuugguaaggggauucaccaaaucuucggcgccgcguuuaaauccuuguucggaggcaugucuugguuuucgcagauccugauugggacccuccugauguggcuuggacugaaugccaagaacggcagcaucuccuugaugugucucgcucugggugggguuuuaauuuuccugucaacggcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6071 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugcaggacacgggucaugaaaccgaugagaaucgcgcaaaggucgagauuacaccaaacucccccagagcugaagccacucuuggcggguucggaucacugggcuuggacugugagccuaggaccggucucgauuuuagugaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagguuaauuacagccaauccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaacagccuugguaaggggauucaccaaaucuucggcgccgcguuuaaauccuuguucggaggcaugucuugguuuucgcagauccugauugggacucuccugauguggcuuggacugaauaccaagaacggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6072 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacacucggaaaggcauuuaguaccacacugaaaggugcccagcgccuugcugccuugggcgauacugcaugggacuucgggagcauuggaggcgucuucaauuccaucgguagagcugugcaccaaguauuugggggcgccuucaggacccuguuuggaggcaugucuuggaucacgcaggggcucaugggagcgcugcuucuguggaugggcgugaacgcccgugaucggucgauugcuuuggcauuccucgccaccggugggguucuggucuuuuuagcuacaaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6073 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaacccucggaaaggcauuuaguacaacucugaaaggugcccagcgccuugcugccuugggcgauaccgcaugggacuucgggagcauaggaggcguguucaauuccauugguagagcuguacaccaaguguuugggggcgccuucaggacgcuguuuggaggcaugucuuggaucacccaggggcucaugggagcgcugcuucuguggaugggcguuaacgcccgugaucggucgaucgcuuuggcauuccucgccacaggugggguccugguguuuuuagcuacuaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6074 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacacucggaaaggcguucaguaccacacugaaaggugcucagcggcuugccgcauugggcgacacugccugggauuucgggagcauuggaggcguguuuaauuccaucggucgcgcuguucaccaagucuucgggggcgccuuuagaacccuguucggaggcaugucuuggaucacgcaggggcucaugggagcacugcuucuguggaugggcgugaacgcuagggaccguucgauugccuuggcguuucucgccaccgguggggugcuggucuucuuagcuacaaacguucaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6075 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacacucggaaaggcauuuaguaccacacugaaaggugcccagcgccuugcugccuugggcgauacugcaugggacuucgggagcauaggaggcguguucaauuccauugguagagcuguacaccaaguguuugggggcgccuucaggacccuguuuggaggcaugucuuggaucacgcaggggcucaugggagcgcugcuucuguggaugggcguuaacgcccgugaucggucgaucgcuuuggcauuccucgccaccggugggguccugguguuuuuagcuacaaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6076 - RNA, 2524 nt, Artificial Sequence; identical to SEQ ID NO: 6053
  ZIKV (strain ZikaSPH2015) Polyprotein(93-804) mRNA Design 2 opt

SEQ ID NO: 6077 - RNA, 2521 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6078 - RNA, 2518 nt, Artificial Sequence
  ZIKV prME variant mRNA Design 2 opt
ggggcgcugccuacggagguggcagccaucuccuucucggcaucaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6079 - RNA, 2515 nt, Artificial Sequence
  ZIKV prME variant mRNA Design 2 opt
ggggcgcugccuacggagguggcagccaucuccuucucggcaucaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6080 - RNA, 2512 nt, Artificial Sequence
  ZIKV prME variant mRNA Design 2 opt
ggggcgcugccuacggagguggcagccaucuccuucucggcaucaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6081 - RNA, 2509 nt, Artificial Sequence
  ZIKV prME variant mRNA Design 2 opt
ggggcgcugccuacggagguggcagccaucuccuucucggcaucaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6082 - RNA, 2506 nt, Artificial Sequence
  ZIKV prME variant mRNA Design 2 opt
ggggcgcugccuacggagguggcagccaucuccuucucggcaucaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6083 - RNA, 2503 nt, Artificial Sequence
  ZIKV prME variant mRNA Design 2 opt
ggggcgcugccuacggagguggcagccaucuccuucucggcaucaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6084 - RNA, 2500 nt, Artificial Sequence
  ZIKV prME variant mRNA Design 2 opt
ggggcgcugccuacggagguggcagccaucuccuucucggcaucaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6085 - RNA, 2497 nt, Artificial Sequence
  ZIKV prME variant mRNA Design 2 opt
ggggcgcugccuacggagguggcagccaucuccuucucggcaucaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6086 - RNA, 2494 nt, Artificial Sequence
  ZIKV prME variant mRNA Design 2 opt
ggggcgcugccuacggagguggcagccaucuccuucucggcaucaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6087 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6088 - RNA, 2488 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6089 - RNA, 2485 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6090 - RNA, 2482 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6091 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6092 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6093 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6094 - RNA, 2515 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcuccguggauuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6095 - RNA, 2515 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcuccguggauuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6096 - RNA, 2506 nt, Artificial Sequence
  ZIKV prME variant mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6097 - RNA, 2503 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6098 - RNA, 2500 nt, Artificial Sequence
  ZIKV prME variant mRNA Design 2 opt
ggggcgcugccuacggagguggcagccaucuccuucucggcaucaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6099 - RNA, 2497 nt, Artificial Sequence
  ZIKV prME variant mRNA Design 2 opt
ggggcgcugccuacggagguggcagccaucuccuucucggcaucaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6100 - RNA, 2494 nt, Artificial Sequence
  ZIKV prME variant mRNA Design 2 opt
ggggcgcugccuacggagguggcagccaucuccuucucggcaucaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6101 - RNA, 2491 nt, Artificial Sequence
  ZIKV prME variant mRNA Design 2 opt
ggggcgcugccuacggagguggcagccaucuccuucucggcaucaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6102 - RNA, 2488 nt, Artificial Sequence
  ZIKV prME variant mRNA Design 2 opt
ggggcgcugccuacggagguggcagccaucuccuucucggcaucaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6103 - RNA, 2485 nt, Artificial Sequence
  ZIKV prME variant mRNA Design 2 opt
ggggcgcugccuacggagguggcagccaucuccuucucggcaucaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6104 - RNA, 2482 nt, Artificial Sequence
  ZIKV prME variant mRNA Design 2 opt
ggggcgcugccuacggagguggcagccaucuccuucucggcaucaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6105 - RNA, 2479 nt, Artificial Sequence
  ZIKV prME variant mRNA Design 2 opt
ggggcgcugccuacggagguggcagccaucuccuucucggcaucaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6106 - RNA, 2476 nt, Artificial Sequence
  ZIKV prME variant mRNA Design 2 opt
ggggcgcugccuacggagguggcagccaucuccuucucggcaucaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6107 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6108 - RNA, 2470 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6109 - RNA, 2467 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6110 - RNA, 2464 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6111 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6112 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6113 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6114 - RNA, 2497 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6115 - RNA, 2497 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6116 - RNA, 2497 nt, Artificial Sequence
  ZIKV prME variant mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6117 - RNA, 2494 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6118 - RNA, 2491 nt, Artificial Sequence
  ZIKV prME variant mRNA Design 2 opt
ggggcgcugccuacggagguggcagccaucuccuucucggcaucaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6119 - RNA, 2488 nt, Artificial Sequence
  ZIKV prME variant mRNA Design 2 opt
ggggcgcugccuacggagguggcagccaucuccuucucggcaucaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6120 - RNA, 2485 nt, Artificial Sequence
  ZIKV prME variant mRNA Design 2 opt
ggggcgcugccuacggagguggcagccaucuccuucucggcaucaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6121 - RNA, 2482 nt, Artificial Sequence
  ZIKV prME variant mRNA Design 2 opt
ggggcgcugccuacggagguggcagccaucuccuucucggcaucaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6122 - RNA, 2479 nt, Artificial Sequence
  ZIKV prME variant mRNA Design 2 opt
ggggcgcugccuacggagguggcagccaucuccuucucggcaucaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6123 - RNA, 2476 nt, Artificial Sequence
  ZIKV prME variant mRNA Design 2 opt
ggggcgcugccuacggagguggcagccaucuccuucucggcaucaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6124 - RNA, 2473 nt, Artificial Sequence
  ZIKV prME variant mRNA Design 2 opt
ggggcgcugccuacggagguggcagccaucuccuucucggcaucaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6125 - RNA, 2470 nt, Artificial Sequence
  ZIKV prME variant mRNA Design 2 opt
ggggcgcugccuacggagguggcagccaucuccuucucggcaucaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6126 - RNA, 2467 nt, Artificial Sequence
  ZIKV prME variant mRNA Design 2 opt
ggggcgcugccuacggagguggcagccaucuccuucucggcaucaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6127 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6128 - RNA, 2461 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6129 - RNA, 2458 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6130 - RNA, 2455 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6131 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6132 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6133 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6134 - RNA, 2488 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6135 - RNA, 2488 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6136 - RNA, 2494 nt, Artificial Sequence
  ZIKV prME variant mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6137 - RNA, 2488 nt, Artificial Sequence
  ZIKV prME variant mRNA Design 2 opt
ggggcgcugccuacggagguggcagccaucuccuucucggcaucaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6138 - RNA, 2491 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6139 - RNA, 2485 nt, Artificial Sequence
  ZIKV prME variant mRNA Design 2 opt
ggggcgcugccuacggagguggcagccaucuccuucucggcaucaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6140 - RNA, 2482 nt, Artificial Sequence
  ZIKV prME variant mRNA Design 2 opt
ggggcgcugccuacggagguggcagccaucuccuucucggcaucaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6141 - RNA, 2479 nt, Artificial Sequence
  ZIKV prME variant mRNA Design 2 opt
ggggcgcugccuacggagguggcagccaucuccuucucggcaucaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6142 - RNA, 2476 nt, Artificial Sequence
  ZIKV prME variant mRNA Design 2 opt
ggggcgcugccuacggagguggcagccaucuccuucucggcaucaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6143 - RNA, 2473 nt, Artificial Sequence
  ZIKV prME variant mRNA Design 2 opt
ggggcgcugccuacggagguggcagccaucuccuucucggcaucaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6144 - RNA, 2470 nt, Artificial Sequence
  ZIKV prME variant mRNA Design 2 opt
ggggcgcugccuacggagguggcagccaucuccuucucggcaucaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6145 - RNA, 2467 nt, Artificial Sequence
  ZIKV prME variant mRNA Design 2 opt
ggggcgcugccuacggagguggcagccaucuccuucucggcaucaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6146 - RNA, 2464 nt, Artificial Sequence
  ZIKV prME variant mRNA Design 2 opt
ggggcgcugccuacggagguggcagccaucuccuucucggcaucaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6147 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6148 - RNA, 2458 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6149 - RNA, 2455 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6150 - RNA, 2452 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6151 - RNA, 2449 nt, Artificial Sequence; identical to SEQ ID NO: 6057
  ZIKV (strain ZikaSPH2015) Polyprotein(108-794) mRNA Design 2 opt

SEQ ID NO: 6152 - RNA, 2449 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6153 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6154 - RNA, 2485 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6155 - RNA, 2485 nt, Artificial Sequence
  ZIKV prME variant mRNA Design 2 opt
ggggcgcugccuacggagguggcagccaucuccuucucggcaucaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6156 - RNA, 2524 nt, Artificial Sequence; identical to SEQ ID NO: 6053
  KU321639.1 prME-long mRNA Design 2 opt

SEQ ID NO: 6157 - RNA, 2524 nt, Artificial Sequence; identical to SEQ ID NO: 6054
  KU312312.1 prME-long mRNA Design 2 opt

SEQ ID NO: 6158 - RNA, 2512 nt, Artificial Sequence; identical to SEQ ID NO: 6055
  AY632535.2 prME-long mRNA Design 2 opt

SEQ ID NO: 6159 - RNA, 2524 nt, Artificial Sequence; identical to SEQ ID NO: 6056
  KU527068.1 prME-long mRNA Design 2 opt

SEQ ID NO: 6160 - RNA, 2524 nt, Artificial Sequence
  KU720415.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauaccggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6161 - RNA, 2506 nt, Artificial Sequence
  DQ859059.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugaugaaaaccgagccaagguagagguuacaccuaauucaccacgcgcagaggcuacucuuggcggguucggaagucugggcuuggacugugaacccagaaccggucucgauuuuagcgaccuguacuauuuaacaaugaacaauaaacacuggcuggugcauaaggagugguuccacgauauuccucucccauggcacgccggggcugacacuggcaccccgcauuggaacaauaaagaagcccuugucgaguuuaaggaugcacacgccaagaggcagacaguggucgugcugggaucccaggaaggcgcuguucauaccgcguuggcaggggcccuagaggcugagauggacggagccaaaggucggcuguucucuggccaccucaagugccgccugaaaauggauaaacuuagacugaagggggugagcuacucauuguguacugcagccuuuacguucacaaagguacccgcugaaacccuccauggaacugucaccguggagguucaguaugccggcacagacgguccuugcaaggugccagcacaaauggcggucgacaugcagacccugacucccguggggagguuaauaacagcuaacccuguaaucacggaaaguaccgagaacuccaaaaugaugcuggaacuagauccacccuuuggcgacagcuacauugugaucggaguuggcgauaagaaaauaacucaccacuggcaucguucugggucaacaauuggaaaggccuucgaggcaaccguccggggugccaaacgaauggcugugcucggcgacacagccugggauuucgggagugugggaggcgucuuuaauagccuggguaaggggauccaccagaucuucggcgcagcuuuuaagucccuuuucggaggcaugucuugguuuucgcaaauuuugaucgggacucugcucguuuggcugggacuuaacaccaaaaauggcagcauuucccugacguguuuggcccucgguggggugaugauauuccugucaaccgcggugagugccgacguaggaugcucugucgauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6162 - RNA, 2524 nt, Artificial Sequence
  KX377335.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccggaagaaaggggaagcacgcagauccaggcgggccgucacacuaccaucucauucgacccgcaagcuccaaacgcgaucacagacuuggcuggagagcagagaguauaccaagcaccuuauaaaaguggaaaauuggaucuuuaggaacccgggauucgcucugguugccguggcgauugcaugguugcucggcaguuccacaucucagaaggucaucuaccuggugaugauucugcucaucgcccccgcuuauagcauacggugcauuggcguauccaaucgugauuuuguugaggggaugucaggagguacuuggguggacgucguguuagaacauggcgggugugugaccgucauggcccaggauaaaccuacaguugacaucgagcuggugaccacgacuguaaguaacauggcagaggugcgcagcuacugcuacgaggcuucuauuuccgauauggccucagacagcagauguccaacacaaggagaagcguaucuugacaagcagagugauacccaguacgucugcaaaaggacuuugguggaccggggcugggguaauggguguggacuguucggcaagggcucucuaguuacaugcgccaaguuuaccugcuccaaaaagaugacggggaaaagcauccagcccgaaaaccucgaguaucgaaucaugcugucggugcacggaucucaacacuccgguaugauugucaaugauaccggcuacgaaacagacgagaaccgcgcaaagguggagguaacuccuaauucaccaagagcugaagccacccuugggggauucggcagucuggguuuggauugugagcccaggacagggcucgacuuuagcgaucuguauuacuuaacuaugaacaauaaacauuggcugguucacaaggaaugguuccaugacauaccucucccauggcacgcuggcgccgauaccggaacaccgcacuggaacaauaaagaggcacuuguggaauuuaaggacgcccaugcuaagcggcagaccgucgugguccugggcucccaggagggggcggugcacacugcauuggccggagcucuagaggccgaaauggauggugcaaaaggcaagcuguucucugggcaucucaaaugccgccugaagauggacaaacuuagacugaagggaguuagcuauucauuguguacggccgcuuuuacauucaccaaggugcccgccgagacucuccacggcaccguaacagucgaagugcaguacgcagguaccgacgggccuugcaaaaucccaguucaaauggcgguggauaugcagacucugacacccgucggcagguuaauuacggcuaacccugugaucaccgagaguacugaaaacuccaagaugaugcuggagcuagacccacccuuuggagauagcuacauaguaauuggcgugggggacaaaaagaucacacaucacuggcaccguucuggaucaaccaucgguaaagccuucgaggcaacaguucggggcgccaagcgaauggcuguccucggggauacugccugggacuucggaagugugggcgguguguuuaauagccuggggaagggcauucaucagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6163 - RNA, 2524 nt, Artificial Sequence
  LC002520.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugaccgucaaugauauuggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6164 - RNA, 2512 nt, Artificial Sequence
  KU963573.2 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugagaaucgagcaaaggucgaggugacaccuaacucaccacgcgcugaagccacucuugggggauucggcagucuggguuuggacugugagcccagaaccgggcucgauuuuagcgaccuguauuacuuaacaaugaauaacaaacacuggcugguacauaaggaaugguuccacgauauaccucucccauggcacgcuggcgccgacacuggaaccccgcauuggaauaacaaagaggcacuuguugaauuuaaggaugcccacgcuaagaggcagacaguggucgugcugggcucccaggagggggcgguccauaccgcauuggccggagcucuagaggccgaaauggacggugcaaaaggcaagcuguucucugggcaccucaaaugccggcugaagauggauaaacuucgccugaagggagugagcuauucauuguguacugccgcuuuuacguucacaaagguucccgccgagacccuccauggcacugugaccguagaaguccaguacgcagguacagacgggccuugcaaaaucccagugcaaauggcgguugacaugcagacccugacucccgugggcagauuaauuacagcuaauccugucaucacggagaguaccgaaaacuccaagaugaugcuggagcuagauccacccuuuggagacagcuacauagugauuggcguaggggauaaaaagaucacucaccacuggcauaggucuggaucaacaaucgguaaagccuucgaggcaaccgugcguggcgccaagcggauggcuguucucggggacacagccugggauuucggaagugucggcgguguguuuaacagccuggggaagggcauucaccagaucuucggagcagcuuuuaaaucccuuuucggcgggaugucuugguuuucgcaaauuuugauaggaacucugcucguguggcugggccuuaauaccaagaacgguagcaucucccugacguguuuggcccucgggggagucaugauuuuccugucaaccgcgguuagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6165 - RNA, 2524 nt, Artificial Sequence
  KX694534.2 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggagaggcauccaccagauuuucggagccgcuuuuaaauccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6166 - RNA, 2524 nt, Artificial Sequence
  KX447520.1 prME-long mRNA Design 2 opt
ggggcgcugccuacggagguggcagccaucuccuucucggcaucaagcuuaccaugagaaucauuaacgccaggaaggagaaaaagcggcgcggcgcugacgcaagcguggggauagucggacugcuccuuaccacagccauggcggcugaaguuacucgacgugguuccgccuacuauauguaccuggauagaaaugacgcaggcgaggccaucucuuuccccacgaccuuggggaugaacaaaugcuauauucagaucauggauuuaggacacaugugugacgcuacaaugucauacgaaugcccuaugcuggaugagggcguggaaccagacgauguagacuguuggugcaauacuaccaguacauggguggucuaugguaccugucaucacaagaaaggggaggcaaggcggagccgcagagccgugacucuaccgucccauucuacaaggaagcuccaaacccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6167 - RNA, 2524 nt, Artificial Sequence
  KX369547.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggacuggccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcgucggggagaaaaagauuacucaccacuggcaucguucuggaucaacaaucgguaaggcuuucgaggccaccgugcggggcgcaaaacgaauggcuguacugggggacacagccugggauuuuggaagugugggcggugcgcuuaacagcuuggggaaaggcauccaccagauuuucggagccgcuuucaagucccuguuuggcgggaugucuugguucucgcaaauccucauuggaacucugcuuauguggcugggcuugaauaccaagaacgguagcauaucccucaugugucuggcauuagggggaguucugaucuuucuaucaacggccgucagugcugacgugggcugcucuguggauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6168 - RNA, 2524 nt, Artificial Sequence
  KX447515.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacugguaucguucuggaucaacaaucgguaaggcuuuugaggccaccgugcggggcgcaaaacgaauggcuguacucggggacacagccugggauuucggaagugugggcggugcgcugaacagccuugggaaaggcauccaucagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6169 - RNA, 2524 nt, Artificial Sequence
  KU501217.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaauucguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6170 - RNA, 2524 nt, Artificial Sequence
  KU312314.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacuggcccaaauggcagucgauaugcagaccuuaacucccgugggcaggcugaucacagccaacccuguuauuacggaaaguaccgaaaauuccaagaugaugcuagagcucgacccacccuucggagauagcuacaucgugauaggcgucggggagaaaaagauuacucaccacuggcaucguucuggaucaacaaucgguaaggcuuuugaggccaccgugcggggcgcaaaacgaauggcuguacugggggacacagccugggauuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6171 - RNA, 2524 nt, Artificial Sequence
  KX446950.2 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuacccuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaauacgaagaacgguagcauauccuugaugugucucgcauuagggggaguucugaucuuccugucaaccgccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6172 - RNA, 2524 nt, Artificial Sequence
  KY003157.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggucgugagugccgacgugggcugcucugucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6173 - RNA, 2524 nt, Artificial Sequence
  KX811222.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaagugcuuggguggucuaugguaccugucaucacaagaaaggggaggcaaggcggagccgcagagccgugacucuaccgucccauucuacaaggaagcuccaaacccggccccagacguggcuggagucgcgcgaauacacuaagcaccuuauucgaguugagaacuggaucuuuagaaauccuggauucgcucuggccgcggcagccauagcuugguugcucggcucaagcaccagucagaaagugaucuaucuggucaugauucugcucaucgccccagcauacuccauuaggugcaucggcgugucuaaccgggauuuuguagaagggaugagcggagguacauggguugacguggucuuagagcauggcgggugugugacugugauggcucaggauaagcccaccgucgacauagagcugguuacaaccacgguguccaauauggccgaaguacguucauacugcuaugaggcgaguauuagcgauauggccucugacucccgcuguccuacucaaggagaagcauaccuugacaaacagucagauacacaguaugugugcaagagaaccuuggucgacaggggcugggguaacggguguggacuguucggcaaaggcagccuagugacuugcgcuaaguuugccugcaguaagaaaaugacagggaagucuauccagccagagaaucucgaauaccggauuaugcuguccguucacggaagccaacacucggguaugaucgugaacgauaccggccaugagacggacgagaaucgagcuaaagucgaaaucacccccaacucuccucgcgccgaggcaacacuugggggauucggcucccuggguuuggauugugaaccaagaacugggcucgacuuuucagaucuguauuacuuaaccaugaauaacaagcacuggcuggugcauaaagagugguuccacgacauuccgcuccccuggcacgccggcgcugauacaggaacuccucauuggaauaacaaggaagcgcuuguagaguuuaaagacgcacacgccaagaggcagaccguugugguccugggcagucaggagggggcugugcauacagccuuggcaggagcccuagaagcugagauggauggugccaagggccggcugagcuccgggcaccucaaaugccgccugaagauggacaaacuuagacugaagggagucucuuauagcuuguguaccgcagcguucacuuuuacgaaaauaccagcugaaacacuccauggcaccgugacuguugaggugcaguacgccgguaccgacgggcccugcaagguaccugcacaaauggccgucgauaugcagacacugaccccagugggcagguuaaucacugcuaaccccguuauuacagaaucaacggagaauaguaagaugaugcuggagcuagacccgccuuucggagauuccuacaucgugauaggcgucggggagaaaaagauuacccaccacuggcaucguagcggaucuacuaucgguaaagccuuugaagcaacagugcggggcgcuaagcgaauggccguacucggggacaccgcgugggauuucggaucagugggcggugcccugaacagucuugggaaaggcauccaccagauuuucggagcugcauuuaagagcuuguucggcgggauguccugguuuucucaaauccugauuggaacacuccugauguggcuuggccugaauacuaagaacgguucgaucagcuugaugugucucgccuuagggggaguucugauauuccuguccaccgcugucucagccgacgugggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6174 - RNA, 2524 nt, Artificial Sequence
  KX447516.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacauccaaaaaggugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaaaccaacagucgacauagagcugguuaccacgacugugucaaauauggcugaaguacguaguuacugcuaugaggccagcauuucugauauggcguccgacucacgcugucccacacagggagaagccuaccuugacaagcaaagcgauacccaguaugugugcaaaagaacuuuggucgacaggggcugggguaacggguguggacuguucggcaagggcagucuagugacaugcgcaaaguuugcuugcucuaaaaagaugaccgggaaauccauccagccugagaaucucgaauaccggauuaugcugagcguucacggaucgcagcacucugguaugaucgugaacgauacgggccaugagaccgacgagaaucgagccaaggucgaaaucacaccaaacucaccccgcgcugaggccacucuugggggauucggcucccuggguuuggauugugaaccuagaaccgggcucgacuuuagugaucuguauuacuuaacaaugaauaacaaacacuggcuggugcauaaggagugguuccacgacauuccacucccguggcacgcaggcgccgauacuggaacaccccauuggaauaacaaagaagcucuuguagaguuuaaggacgcgcacgcaaagaggcaaaccguugugguccugggcagccaggagggggccgugcauaccgcuuuggccggagcacuagaagccgagauggauggugcuaaaggccggcuguccucugggcaccucaagugccgccugaaaauggacaagcugagacugaaaggagucagcuauucauuguguacugccgcauucacguuuacaaagauaccugcggaaacccuccauggcacugugaccguugaggugcaguacgcugguacagacgggccaugcaagguacccgcccagauggcagucgauaugcaaacccugacuccugugggcagguuaaucacagccaacccaguuauuacggaaaguaccgaaaauuccaaaaugaugcuggagcuagaucccccguucggagacagcuacaucgugauaggcgucggggagaagaaaauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaagggcauccaccagauuuucggagccgcuuuuaaguccuuguucggcgggaugucuugguuuucgcagauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6175 - RNA, 2524 nt, Artificial Sequence
  KX520666.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaaggcagaaagugaucuaucuggucaugauucugcucaucgcuccugccuacuccauucggugcaucggcgugucuaaccgugauuuuguagaagggaugagcggagguacuuggguugacguggucuuagagcauggcgggugugugaccgugauggcacaggauaagccaacagucgacauagagcugguuaccacgacuguguccaauauggcugaaguacgcucauacugcuaugaggccaguauuagcgauauggcgucugacuccagaugucccacacaaggagaagccuaccuugacaaacagucagauacccaguaugugugcaagaggacuuuggucgaccggggcugggguaacggguguggacuguucggcaaaggcagccuagugacaugcgcaaaguuugcuugcaguaagaaaaugaccgggaagucuauccagccugagaaucucgaauaccgaauuaugcuguccguucacggaagccaacacucggguaugaucgugaacgauacgggccaugagaccgacgagaaucgcgccaaagucgaaaucacaccaaacucucccagagcugaggccacucuugggggauucggcucccuggguuuggauugugaaccuaggaccgggcucgacuuuucagaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagcggcagaccguugugguccugggcagucaggagggggccgugcauaccgcuuuggccggagcacuagaagccgagauggauggugcuaagggccgccugagcuccgggcaccucaaaugcagacugaagauggacaaacuuaggcugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggccguuuaaucacagccaacccaguuauuacggaaucaaccgagaauaguaagaugaugcuggagcuagaucccccguucggagacuccuacaucgugauaggcgucggggagaaaaagauuacucaccacuggcaucggagcggaucuacaaucgguaaggcuuuugaagccaccgugcgaggcgcaaaaagaauggcuguacucggggacacagccugggauuucggaucagugggcggugcgcugaacagucuugggaaaggcauccaccagauuuucggagccgcuuuuaagagcuuguucggcgggauguccugguuuucucaaauccugauuggaacucuccugauguggcuuggccugaauaccaagaacgguucgaucagcuugaugugucucgcauuagggggaguucugauauuccuguccacggccgucucagcugacgugggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6176 - RNA, 2524 nt, Artificial Sequence
  KU729218.1 prME-long mRNA Design 2 opt
ggggcgcugccuacggagguggcagccaucuccuucucggcaucaagcuuaccaugagaaucauuaacgccaggaaggagaaaaagcggcgcagcgcugacaccuccgugggcauagucgggcugcuccuuacaacugcaauggccgcggaaguuacgcgacguggaucugcuuacuauauguaccuggauagaaaugacgccggugaggcaaucucauuccccaccacauugggcaugaacaaaugcuauauucagaucauggauuuagggcacaugugugacgccacuaugaguuacgaaugcccuaugcuggaugagggaguggaaccagacgauguagacuguuggugcaauaccacaagcaccuggguggucuauggcacuugucaucacaagaaaggugaggcuaggcggucccgcagagcagugacacuaccgucucauucgaccaggaagcuccaaacgcggucacagacuuggcuggagagccgcgaauacaccaagcaccuuauucgaguugagaacuggaucuuuagaaaucccggguucgcccuggcugccgcggcaauagccugguugcucggaaguuccacaucucagaaagugaucuaucuggucaugauucugcucaucgcuccugccuacagcauuaggugcaucggcguguccaaccgggauuuuguagaaggcaugucagggggaacuuggguugacguggucuuagagcaugguggcugugugaccgugauggcacaggauaagccaacagucgacauagagcugguuaccacgacugugaguaauauggcugaaguacguagcuacugcuaugaggccucuauuuccgauauggcgucagacagccgcugucccacacaaggggaagccuaccuugacaaacagagugauacccaguaugugugcaagagaacuuuggucgacaggggauggggcaacgguugugggcuguucggaaaaggcucucuagugacaugcgcaaaguuugcuugcuccaagaaaaugaccggcaagagcauccagccugagaaucucgaauaccggauuaugcugucgguucacgggucucaacacuccggaaugaucgugaacgauacgggucaugagaccgacgagaaucgagccaaagucgaaaucacaccaaacucaccccgcgcugaggccacucuuggcggguucggaagucugggcuuggauugugaaccuagaaccggucucgacuuuagcgaucuguauuacuuaacaaugaauaacaagcacuggcuggugcauaaagagugguuccacgacauuccacucccguggcacgcaggggccgauacuggcacaccccauuggaauaacaaggaagcucuuguagaguuuaaagacgcgcacgcaaagaggcagaccguugugguccugggaucccaggagggcgccgugcauaccgcuuuggccggggcacuagaagccgagauggauggagcuaagggucggcugucuagcggccaccucaaaugccgccugaagauggacaaacuuagacugaagggggucucauauaguuuguguacugccgcauucacguuuacaaaaauaccugcggaaacccuccauggaacugugaccguugaggugcaguacgcuggcacagacgguccaugcaagguacccgcccaaauggcagucgauacccagacucugacaccuguggggagguuaaucacggccaacccaguuauuaccgaauccacugagaauagcaagaugaugcuggagcuagaucccccguucggcgacucuuacaucgugauaggagucggcgagaaaaagauuacacaccacuggcaucguucagggaguaccaucggaaaggcuuuugaagccacagugcggggugcaaaacgaauggcuguacucggcgacacugccugggauuucgggagcgugggaggcgcgcugaacucccuugguaaagggauccaccagauuuucggcgccgcuuuuaagucuuuguucggaggcaugucgugguuuagccaaauccugauugggacccuccugauguggcuuggacugaauacgaagaacggcuccauaucauugaugugucucgcacugggugggguuuuaaucuuccugaguaccgccgucucugcugacgugggaugcagcguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6177 - RNA, 2524 nt, Artificial Sequence
  KU761561.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggaucuuuagaaaccccggauucgcccuggcugccgcggcaauagccugguugcucggcucaagcacaagucagaaagugaucuaucuggucaugauucugcucaucgcuccugccuacuccauuaggugcaucggcgugucuaaucgggauuuuguagaagggaugagcggagguacuuggguugacguggucuuagagcauggcgggugugugaccgugauggcacaggauaagccaacagucgacauagagcugguuaccacgacuguguccaacauggcugaaguacguucauacugcuaugaggccaguauuagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauccagccugagaaccucgaauaccggauuaugcuguccguucacggaagccaacacucggguaugaucgugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacauuccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaauccaguuauuacggaaucaaccgagaacaguaagaugaugcuggagcuagaucccccguucggagacuccuacaucgugauaggcgucggggagaaaaagauuacucaccacuggcaucguagcggaucuacaaucgguaaggcuuuugaagccaccgugcggggcgcacgaagaauggcuguacucggggacacagccugggauuucggaucagugggcggugcgcugaauagucuugggaaaggcauccaccagauuuucggagccgcuuuuaagagcuuguucggcgggauguccugguuuucucaaauccugauuggaacucuccugauguggcuuggccugaacaccaaaaaugguucgaucagcuugaugugucucgcauuagggggaguucugauauuccuguccacggccgucucagcugacgugggcugcaguguggauuuuucuaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6178 - RNA, 2524 nt, Artificial Sequence
  KY317938.1 prME-long mRNA Design 2 opt
ggggcgcugccuacggagguggcagccaucuccuucucggcaucaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggacuuuguagaggggauguccggagguacuuggguugauguggucuuagagcauggcgggugugugaccgugauggcacaggacaagccaacagucgauauagaacugguuaccacgacugugucaaauauggcugagguacguaguuacugcuaugaagccagcauuucugacauggcguccgauucacgcugucccacacaaggagaggccuaccuugacaaacagagcgacacccaguaugugugcaagagaacuuuggucgauaggggcugggguaacggguguggacuguucggcaaaggcagucuagugacaugcgcaaaguuugcuugcucuaagaaaaugaccgggaaguccauccagccugaaaaucucgaguaccggauuaugcugagcguucacggaucgcaacacucugguaugaucgugaacgacacgggccaugagaccgaugaaaaucgagccaaagucgagaucacaccaaacucaccccgcgcugaagccacucuugggggauucggcucccuggguuuggacugugagccuagaaccgggcucgauuuuagugaccuguauuacuuaacaaugaauaacaagcacuggcuggugcauaaagaaugguuccacgauauuccacucccguggcacgcaggcgccgacacuggaacaccccauuggaauaacaaggaggcucuuguagaguuuaaagaugcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6179 - RNA, 2524 nt, Artificial Sequence
  KY075939.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuuuaaggugcauuggcgugagcaaccgggauuuuguagaagggauguccggagguacuuggguugacgugguccuggagcauggcgggugugugaccgugauggcacaggauaagccaacagucgacaucgagcuuguuaccacgacugugucaaauauggcugaaguacguaguuacugcuaugaggccagcauaucugauauggcguccgacucacgcugucccacacaaggagaagccuacuuggacaaacagagcgauacccaguaugugugcaagagaacucuggucgacaggggcugggguaacggguguggacuauucggcaaaggcagucucgugacaugcgcaaaguuugcuugcucuaagaaaaugaccgggaaguccauucagccugagaaucuggaauaccggaucaugcuuagcguucacggaucgcaacacucugguaugauugugaacgauacgggccaugagaccgacgagaaucgagccaaagucgaaaucacaccaaacucaccccgcgcugaggccacucugggaggguucggcuccuugggucucgauugugaaccuagaaccgggcuggacuuuagugauuuauauuaccugacaaugaauaacaagcacuggcucgugcauaaagagugguuccacgacaucccacuuccguggcacgcaggcgccgauacuggaacaccccauuggaauaacaaggaagcucugguagaguuuaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauucacguuuacaaaaauuccugcggaaacccugcauggcacugugaccguugaggugcaguacgcugguacagacgggccaugcaagguacccgcccaaauggcagucgauaugcagaccuuaacuccugugggcaggcugauaacagccaacccaguuaucacggaaaguaccgaaaauuccaagaugaugcuagagcucgaucccccguucggagacagcuacauugugaucggcgucggggagaaaaagauaacucaccacuggcaucguucuggaucaacaauugguaaggcuuuugaggccaccgugcggggcgcaaaacgaauggcuguacugggggacacagccugggauuucggaagugugggcggugcgcuuaacagcuuggggaaaggcauccaccagaucuucggagccgcuuuuaagucccuguucggcgggaugucuugguuuucgcaaauucucaucggaacucugcuuauguggcugggcuugaauaccaagaacgguagcauuucccucaugugucuggcauuagggggaguucugauauuccuaucaacggccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6180 - RNA, 2524 nt, Artificial Sequence
  KX806557.2 prME-long mRNA Design 2 opt
ggggcgcugccuacggagguggcagccaucuccuucucggcaucaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggauguuuagaaaccccggauucgcccuggcugccgcggcaaucgccugguugcucggcucaagcacaagucagaaagugauauaucuggucaugauccugcucauugcuccugccuacuccaucaggugcauuggcgugucuaaucgggauuuuguagaagggaugagcggagguacuuggguugacguggucuuagagcauggcgggugugugaccgugauggcacaggauaagccaacagucgacaucgagcugguuaccacgacuguguccaacauggcugaaguacguucauacugcuaugaggccaguauaagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauucagccugagaaccucgaauaccggaucaugcuguccguucacggaagccaacacucggguaugauugugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacaucccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauuccugcggaaacccuccauggcacugugaccguugaggugcaguacgcugguacagacgggccaugcaagguacccgcccaaauggcagucgauaugcagacccugacuccugugggcagguuaauaacagccaauccaguuaucacggaaucaaccgagaacaguaagaugaugcuggagcuagaucccccguucggagacuccuacauugugaucggcgucggggagaaaaagauaacucaccacuggcaucguagcggaucuacaauugguaaggcuuuugaagccaccgugcggggcgcaaaacgaauggcuguacucggggacacagccugggauuucggaucagugggcggugcgcugaauagucuugggaaaggcauccaccagaucuucggagccgcuuuuaagagcuuguucggcgggauguccugguuuucucaaauucugaucggaacucuccugauguggcuuggccugaacaccaagaaugguucgauuagcuugaugugucucgcauuagggggaguucugauauuccuguccacggccgucucagcugacgugggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6181 - RNA, 2524 nt, Artificial Sequence
  KU870645.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggauccugagaaaucccggauuugccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcauuggggagaaaaagaucacucaccacuggcaucguucuggaucaacaaucgguaaggcuuucgaggccaccguccggggcgcaaaacgaauggcugugcugggggacacagccugggauuuuggaaguguaggcggugcgcuuaacagcuuggggaaaggcauucaccagaucuucggagccgcuuucaagucccuguuuggcgggaugucuugguucucgcaaauucucauaggaacucugcuuauguggcugggcuugaauaccaagaacgguagcaucucccucaugugucuggcauuagggggagugcugauuuuucuaucaacggccguuagugcugacgucggcugcucuguggauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6182 - RNA, 2524 nt, Artificial Sequence
  KU729217.2 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuucaaccacggugaguaauauggcugaaguacguagcuacugcuaugaggccacuauuucugauaucgcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccgccguugugcugggcagccaggagggggcuguccauaccgccuuggcaggagcccuagaagcugagauggauggugccaagggccggcuguccucugggcaccucaaaugccgccugaagauggacaaacuuagacugaagggagugagcuauucauuguguacugcagcguucacguuuacaaaaaucccugcugaaacccuccauggcacugucaccguggagguucaguacgccgguacagacgggccaugcaaggugcccgcacaaauggccguagauaugcagacccugacuccugucggcagguuaauuacagcuaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaagccuuugaggcaaccguccggggcgcuaagcgaauggccgugcucggggacacagcgugggauuucggaaguguaggcggugcccugaacagccuugggaaaggcauucaccagaucuucggagcugcauuuaaguccuuguucggcgggaugucuugguuuucgcaaauucugauaggaacucuccugauguggcuuggccugaauaccaagaacgguagcaucuccuugaugugucucgccuuagggggagugcugauuuuccugucaacggcuguuagugccgacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6183 - RNA, 2524 nt, Artificial Sequence
  KU497555.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacagcccccgcgcugaggccacucuugggggauucggcucacuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcacccaggagggggccgugcauacugcuuuggccggagcacuagaagccgagauggauggugcuaagggccggcugagcuccgggcaccucaaaugccgccugaagauggacaaacuuagacugaagggagucucuuauagcuuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaucaacugagaauaguaagaugaugcuggagcuagaucccccguucggagacuccuacaucgugauaggcgucggggagaaaaagauuacacaccacuggcaucguagcggaucuaccaucgguaaggcuuuugaagccacagugcggggcgcaaaacgaauggcuguacucggggacacugccugggauuucggaucagugggcggugcgcugaacagucuugggaaaggcauccaccagauuuucggagccgcuuuuaagagcuuguucggcgggauguccugguuuucucaaauccugauuggaacccuccugauguggcuuggccugaauacgaagaacgguucgauauccuugaugugucucgcauuagggggaguucugaucuuccuguccaccgccgucucagcugacgugggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6184 - RNA, 2524 nt, Artificial Sequence
  KX087101.3 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugagcugcaguacgcugguacagacgggccaugcaaggugcccgcccaaauggcaguagauaugcagaccuuaacuccugucggcaggcugaucacagccaacccagugauuacggaaaguaccgaaaauuccaagaugaugcuagagcucgaucccccguucggagacagcuacaucguuauaggcgugggggagaaaaagauuacucaccacuggcaucguucuggaucaacaaucgguaaggcuuuugaggccaccguccggggcgcaaaacgaauggcugugcugggggacacagccugggauuucggaaguguaggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggagugcugaucuuccuaucaacggccguuagugcugacgucggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6185 - RNA, 2524 nt, Artificial Sequence
  KY075932.1 prME-long mRNA Design 2 opt
ggggcgcugccuacggagguggcagccaucuccuucucggcaucaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaaucgaaaacuggauauuuagaaaucccggauucgcccuggcugccgcggcaaucgccugguugcucggcagcaguacaucccagaaaguuauuuaucuggugaugauccugcucauugcuccugccuacucuaucaggugcauaggcgucagcaaccgggacuuuguggaggggauguccggagguacuuggguagauguuguguuagagcauggcgggugugucaccgugauggcacaggacaagccaacaguggauauugaacuggucaccacgacuguuucaaauauggcugaggugcguaguuacugcuaugaagccagcaucucugacauggcguccgauucacgcugucccacacaaggagaggccuaccuugacaaacagagcgacacccaguauguaugcaagagaacuuugguggauaggggcugggguaacggguguggacuguucggcaaaggcagucuagucacaugcgcaaaguuugcuugcucuaagaaaaugaccgggaaguccauucagccugaaaaucucgaguaccggaucaugcugagcgugcacggaucgcaacacucugguaugaucguuaacgacacgggccaugagaccgaugaaaaucgagccaaaguggagauuacaccaaacucaccccgcgcugaagccacucuugggggauucggcucccuggguuuggacugugagccuagaaccgggcucgauuuuagugaccuguauuacuuaacaaugaauaacaagcacuggcugguccauaaagaaugguuccacgauauaccacucccguggcacgcaggcgccgacacuggaacaccccauuggaauaacaaggaggcucuuguggaguuuaaagaugcgcacgcaaagaggcagaccguaguugugcugggcagccaggaaggggccguccauaccgcuuuggccggagcacuagaggccgaaauggacggugcuaagggccggcuguccucugggcaccucaaaugccgccugaagauggauaaacuuagacugaagggagugagcuauucauuguguacugccgcauucacguuuacaaaaaucccugcggagacccuccauggcacugucaccguggaaguucaguacgcugguacagacgggccaugcaaggugcccgcccaaauggcaguagacaugcagacccugacuccugucggcagguuaauuacagccaacccagugaucacggagaguaccgaaaauuccaagaugaugcuggagcuagaucccccguucggagacagcuacauaguuauuggcgugggggagaaaaagaucacucaccacuggcaucguucuggaucaacaaucgguaaggcuuuugaagccaccguccggggcgcaaaacgaauggcugugcucggggauacagccugggacuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugaugucggcugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6186 - RNA, 2524 nt, Artificial Sequence
  KY014317.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaucgaaaauuccaagaugaugcuggagcuagaucccccguucggagacagcuacauagugauuggcgucggggagaaaaagaucacccaccacuggcaucguucuggaucaacuaucgguaaggcuuuugaggccacagugcggggcgcaaaacgaauggcuguacucggggacaccgccugggauuucggaagugugggcggugcgcugaacagccuugggaaaggcauucaccagaucuucggagccgcuuuuaaguccuuguucggcgggaugucuugguuuucgcaaauucugauaggaacacuccugauguggcuuggccugaauacuaagaacgguagcaucuccuugaugugucucgcauuagggggaguucugauuuuccugucaaccgccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6187 - RNA, 2524 nt, Artificial Sequence
  KU758876.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugucaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuucauguguuuggcucucgggggaguccugaucuuuuuaucaacggcagugagugccgacgugggcugcucugucgauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6188 - RNA, 2524 nt, Artificial Sequence
  KU758874.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggcaaacuguccucugggcaccucaagugccggcugaaaauggacaagcugcgccugaaaggagucagcuauucauuguguacugccgcauucacguuuacaaagauaccugcggaaacccuccauggcacugugaccguugaggugcaguacgcugguacagacgggccaugcaagguacccgcccaaauggcagucgauaugcagacccugacuccugugggcagauuaaucacagccaacccaguuauuacggaaaguaccgaaaauuccaaaaugaugcuggagcuagaucccccguucggagacagcuacaucgugauaggcgucggggagaagaaaauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaagggcauccaccagauuuucggagccgcuuuuaaguccuuguucggcgggaugucuugguuuucgcaaauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6189 - RNA, 2524 nt, Artificial Sequence
  KY014314.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagaggcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6190 - RNA, 2524 nt, Artificial Sequence
  KU926310.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcuggugccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6191 - RNA, 2524 nt, Artificial Sequence
  KU761560.1 prME-long mRNA Design 2 opt
ggggcgcugccuacggagguggcagccaucuccuucucggcaucaagcuuaccaugagaaucauuaacgccggcaaggagaaaaagaggcgcggggcugacaccaaugugggaauagucggucugcuccuuacaacugcaauggccgcggaaguuacgcggcgaggcagcgcuuacuauauguaccuggaucguaacgacgccggggaggcaaucuccuuccccaccacauugggaaugaauaaaugcuauauucagaucauggauuuaggccacaugugugacgccacuaugucuuacgaaugcccuaugcuggaugaggguguggaaccagacgauguagacuguuggugcaacaccacaucaaccuggguggucuaugggacuugucaucacaagaaaggagaggcuagaaggagucggcgcgcagugacacuaccgagccauuccaccagaaagcuccaaacgaggucucagacuuggcuggagucgcgggaauacaccaagcaccuuauucgcguugagaauuggaucuuucgaaaccccggcuucgcccuggcugccgcggcaauagccugguugcucggcucaagcacaagucagaaagugaucuaucuggucaugauucugcucaucgcuccugccuacuccauuagaugcaucggggugucuaauagggauuuuguagaaggaaugagcgguggcacuuggguugacguggucuuagagcaugggggaugugugaccgugauggcacaggauaagccaacagucgacauagagcugguuaccacgacuguguccaacauggcugaaguacggucauacugcuaugaggccaguauuagcgauauggcgucugacucccguugucccacacaaggcgaagccuaccuugacaaacagucagauacccaguaugugugcaagcgcacuuuggucgacagagguugggggaauggauguggccuguucggcaaagggagccuagugacaugcgcaaaguuugcuugcaguaagaaaaugaccggaaagucuauccagccugagaaccucgaauacaggauuaugcuguccguucacgguagccaacacucgggcaugaucgugaaugauacggggcaugagaccgacgagaaccgggccaaagucgaaaucacaccaaauucuccccgagcugaggccacucuuggaggcuucgguucccugggguuggauugugaaccucgcaccggccucgacuuuucagaucuguauuacuuaacaaugaacaauaagcacuggcuggugcauaaagagugguuccacgacauuccacucccguggcacgcaggagccgauacuggcacaccccauuggaacaacaaggaagcucuuguagaguuuaaagacgcgcacgcaaagagacagaccguugugguccuggggagucaggagggagccgugcauaccgcuuuggccggugcacuagaagccgagauggauggcgcuaaggggaggcugagcuccggacaccucaaaugccggcugaagauggacaaacuucgccugaagggcgucucuuauagcuuguguacugccgcauucacguuuacaaaaauaccugcggaaacccuccaugguacugugaccguugaggugcaguacgcugggacagacggcccaugcaagguacccgcccaaauggcagucgauaugcagacccugacuccugugggaagauuaaucacagccaauccaguuauuacggaaucaaccgagaacaguaagaugaugcuggagcuagaucccccguucggcgacuccuacaucgugauaggggucggagagaaaaagauuacucaccacuggcauaggagcgguucuacaaucggcaaggcuuuugaagccaccgugcguggggcacggcgaauggcuguacucggagacacagccugggauuucggcucaguggguggggcgcugaauagucuuggcaaaggaauccaccagauuuucggcgccgcuuuuaagagcuuguucgggggaauguccugguuuucucaaauccugauuggcacucuccugauguggcuuggucugaacaccaaaaaugggucgaucagcuugaugugucucgcacugggaggcguuuuaauauuccuguccacggccgucucagcugacguggguugcaguguggauuuuucuaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6192 - RNA, 2524 nt, Artificial Sequence
  KY317939.1 prME-long mRNA Design 2 opt
ggggcgcugccuacggagguggcagccaucuccuucucggcaucaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaagaugccggcgaagcaaucucuuuccccaccacauuggggaugaauaagugcuauauucagaucauggacuuaggacacaugugugaugccacuaugucauacgagugcccuaugcuggacgaaggcguggagccagaugacguagauuguuggugcaacaccacaaguaccuggguggucuaugguacuugucaucacaaaaagggggaggcuaggcggagccgcagagcagugacacuaccgucccauucuaccaggaagcuccaaacgcggucgcagacuuggcuggaaucacgcgaguacaccaaacaccuuauucgaguugaaaauuggaucuuuagaaaccccggauucgcccuggcugccgcggcaauagccugguugcucggcagcaguacaucccagaaggugaucuaucuggucaugauucugcucaucgcuccugccuacucuauuaggugcaucggcgugagcaaucgggacuuuguagaggggauguccggagguacuuggguugauguggucuuagagcauggcgggugugugaccgugauggcacaggacaaaccaacagucgauauagaacugguuaccacgacugugucaaacauggcugagguacguaguuacugcuaugaagccagcauuucugacauggcguccgauucacgcugucccacacaaggagaggccuaccuugacaagcagagcgacacccaguaugugugcaaaagaacuuuggucgauaggggcugggguaauggguguggacuguucggcaagggcagucuagugacaugcgcaaaguuugcuugcucuaaaaagaugaccgggaaauccauccagccugaaaaccucgaguaccggauuaugcugagcguucacggaucgcaacacucugguaugaucgugaaugacacgggccaugagaccgaugaaaaccgagccaaggucgagaucacaccaaauucaccccgcgcugaagccacucuugggggauucggcucccuggguuuggacugugagccuagaaccgggcucgauuuuagugaccuguauuacuuaacaaugaacaauaaacacuggcuggugcauaaggaaugguuccacgauauuccacucccguggcacgcaggcgccgacacuggaacaccccauuggaacaauaaagaggcucuuguagaguuuaaggaugcgcacgcaaagaggcagaccguugugguccugggcagccaggaaggggccgugcauaccgcuuuggccggagcacuagaggccgaaauggacggugcuaaaggccggcuguccucugggcaccucaagugccgccugaaaauggauaagcugagacugaaaggagucagcuauucauuguguacugccgcauucacguuuacaaagauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgagaacuccaaaaugaugcuggaacuagaucccccguucggagacagcuacaucgugauaggcgucggggagaagaaaauuacucaccacuggcaucguucuggaucaacaaucgguaaggcuuuugaagccaccgugcggggcgcaaaacgaauggcuguacucggggauacagccugggacuucggaagugugggcggugcgcugaauagccuugggaagggcauccaccagauuuucggagccgcuuuuaaguccuuguucggcgggaugucuugguuuucgcaaauccugauuggaacucuccugauguggcuuggccugaacaccaaaaaugguagcauauccuugaugugucucgcacuugggggaguuuuaaucuuccugucaacggccgucagugcugaugugggcugcucuguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6193 - RNA, 2524 nt, Artificial Sequence
  KY075937.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauaugguguccgacucacgcugucccacacaaggagaagcguaccuugacaaacagagcgauacccaguaugucugcaagagaacuuugguggacaggggcugggguaacggguguggacuguucggcaaaggcagucuaguuacaugcgccaaguuugcaugcucuaagaaaaugaccgggaaguccauccagccugagaaucucgaauaccggauuaugcugagcgugcacggaucgcaacacucugguaugaucgucaacgauacgggccaugagaccgacgagaaucgagcuaaaguggaaaucacaccaaacucaccccgcgccgaggcuacucuugggggauucggcucccuggguuuggauugugaaccuagaaccgggcucgacuuuagugaucuguauuacuuaacaaugaauaacaagcacuggcugguacauaaagagugguuccacgacauuccacucccguggcacgccggcgcagauacuggaacaccccauuggaauaacaaggaagcccuuguugaguuuaaagacgcucacgcgaagaggcagaccguggucgugcugggcagccaggagggggcaguccauaccgccuuggcuggagcccuagaagcagagauggauggugccaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuugaugugucucgcuuuagggggaguccugaucuuccugucaacggcagugagugccgacgugggcugcucugucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6194 - RNA, 2524 nt, Artificial Sequence
  LC191864.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaugaccucaacauggguggucuaugguaccugucaucacaagaaaggggaggcuaggcggagucgcagagcagugacucuaccgagccauuccacaaggaagcuccaaacccggucucagacguggcuggagucgcgcgaauacacuaagcaccuuauucgaguugagaauuggaucuuuagaaaccccggauucgcccuggcugccgcggcaauagccugguugcucggcucaagcaccagucagaaagugaucuaucuggucaugauucugcucaucgcuccugccuacuccauuaggugcaucggcgugucuaaucgggauuuuguagaagggaugagcggagguacauggguugacguggucuuagagcauggcgggugugugacugugauggcacaggauaagccaaccgucgacauagagcugguuacaaccacgguguccaacauggcugaaguacguucauacugcuaugaggccaguauuagcgauauggcgucugacucccgcugucccacucaaggagaagccuaccuugacaaacagucagauacacaguaugugugcaagagaaccuuggucgacaggggcugggguaauggguguggacuguucggcaaaggcagccuagugacuugcgcaaaguuugcuugcaguaagaaaaugacagggaagucuauccagccugagaaccucgaauaccggauuaugcuguccguucacggaagccaacacucggguaugaucgugaaugauaccggccaugagacggacgagaaccgagccaaagucgaaaucaccccaaauucuccccgcgcugaggccacacuugggggauucggcucccuggguuuggauugugaaccuagaacugggcucgacuuuucagaucuguauuacuuaaccaugaacaauaagcacuggcuggugcauaaagagugguuccacgacauuccacucccguggcacgcaggcgccgauacaggaacuccccauuggaacaacaaggaagcucuuguagaguuuaaagacgcgcacgcaaagaggcagaccguugugguccugggcagucaggagggggccgugcauacagcuuuggccggagcacuagaagccgagauggauggugcuaagggccggcugagcuccgggcaccucaaaugccgccugaagauggacaaacuuagacugaagggagucucuuauagcuuguguaccgccgcauucacuuuuacgaaaauaccugcggaaacacuccauggcaccgugacuguugaggugcaguacgcugguaccgacgggccaugcaagguacccgcccaaauggcagucgauaugcagacacugaccccugugggcagguuaaucacugccaauccaguuauuacagaaucaacggagaacaguaagaugaugcuggagcuagaucccccguucggagacuccuacaucgugauaggcgucggggagaaaaagauuacccaccacuggcaucguagcggaucuacuaucgguaaggcuuuugaagccacagugcggggcgcaaaacgaauggcuguacucggggacaccgccugggauuucggaucagugggcggugcgcugaauagucuugggaaaggcauccaccagauuuucggagccgcuuuuaagagcuuguucggcgggauguccugguuuucucaaauccugauuggaacacuccugauguggcuuggccugaacacuaagaaugguucgaucagcuugaugugucucgcauuagggggaguucugauauuccuguccaccgccgucucagcugacgugggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6195 - RNA, 2524 nt, Artificial Sequence
  KX447517.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccgcacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaacacugaucggaacucuccugauguggcuuggccugaauaccaagaacgguagcauuuccuugaugugucucgccuuagggggaguucugauauuccugucaacggcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6196 - RNA, 2524 nt, Artificial Sequence
  KU922923.1 prME-long mRNA Design 2 opt
ggggcgcugccuacggagguggcagccaucuccuucucggcaucaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuuuagccuacucuauuaggugcaucggcgugagcaaccgggacuuuguagaggggauguccggagguacuuggguugaugugguccuggagcauggcgggugugugaccgugauggcacaggacaagccuacagucgauauagaacuuguuaccacgacugugucaaauauggcugagguacguaguuacugcuaugaagccagcauuucugacauggcguccgauucacgcuguccaacacaaggagaggccuacuuggacaaacagagcgacacccaguaugugugcaagagaacucuggucgauaggggcugggguaacggguguggacuauucggcaaaggcagucucgugacaugcgcaaaguuugcuugcucuaagaaaaugaccgggaaguccauccagcccgaaaaucuggaguaccggauuaugcuuagcguucacggaucgcaacacucugguaugaucgugaacgacacgggccaugagaccgaugaaaaucgagccaaagucgagaucacaccuaacuccccacgcgcugaagccacucugggaggguucggcucauugggucucgacugugagcccagaaccgggcuggauuuuagugacuuauauuaccugacaaugaauaacaagcacuggcucgugcauaaagaaugguuccacgauauuccucuuccauggcacgcaggcgccgacacuggaaccccgcauuggaauaacaaggaggcucugguagaguuuaaagaugcgcacgcaaagaggcagacaguuguggucuugggcagccaggaaggggccgugcauaccgcucuagccggagcacuggaggccgaaauggacggugcuaagggccggcucuccucugggcaccugaaaugccgccuuaagauggauaaacugagauugaagggagucagcuauucacucuguacugccgcauucacguuuacaaaaauacccgcggagacccugcauggcacugugaccguugaagugcaguacgcugguacagacgggccuugcaagguaccagcccaaauggcagucgacaugcagaccuuaacucccgugggcaggcugaucacagccaacccuguuauuacggagaguaccgaaaauuccaagaugaugcuagagcucgauccacccuucggagacagcuacaucgugauaggcgucggggagaaaaagauuacucaccacuggcaucguucuggaucaacaaucgguaaggcuuuugaagccaccgugcggggcgcaaaacgaauggcuguacugggggauacagccugggacuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugaugugggcugcucuguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6197 - RNA, 2524 nt, Artificial Sequence
  KY003156.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcauaagcaaccgggauuuuguggaagggauguccggagguacuuggguagacguuguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcauacuggguuuggauugugaaccuagaaccgggcucgacuuuuccgaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagaggcagaccguaguugugcugggcagucaggagggggccguccauaccgcuuuggccggagcacuagaagccgagauggauggugcuaagggccggcugagcuccgggcaccucaaaugccgccugaagauggacaaacuuagacugaagggagugucuuauagcuuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagguuaaucacagccaacccagugauaacggaaucaaccgagaauaguaagaugaugcuggagcuagaucccccguucggagacuccuacauuguuaucggcgugggggagaaaaagaucacucaccacuggcaucguagcggaucuacaauugguaaggcuuuugaagccaccguccggggcgcaaaacgaauggcugugcucggggacacagccugggauuucggaucaguaggcggugcgcugaacagucuugggaaaggcauccaccagauuuucggagccgcuuuuaagagcuuguucggcgggauguccugguuuucucaaauacugaucggaacucuccugauguggcuuggccugaauaccaagaacgguucgauuagcuugaugugucucgcauuagggggagugcugaucuuccuguccacggccguuucagcugacgucggcugcaguguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6198 - RNA, 2524 nt, Artificial Sequence
  KU312313.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuauuaggaagcuccaaacgcggucgcagacuuggcuggagucacgcgaauacaccaagcaccuuauccgaguugagaacuggauauuuagaaaucccggauucgcccuggcugccgcggcaaucgccugguugcucggcagcaguacaucccagaaagugauuuaucuggucaugauccugcucauugcuccugccuacucuaucaggugcauaggcgugagcaaccgggauuuuguagaagggauguccggagguacuuggguugacguggucuuagagcauggcgggugugugaccgugauggcacaggauaagccaacagucgacauugagcugguuaccacgacugugucaaauauggcugaaguacguaguuacugcuaugaggccagcaucucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaaucccugcggaaacccuccauggcacugugaccguugaggugcaguacgcugguacagacgggccaugcaagguacccgcccaaauggcagucgauaugcagacccugacuccugugggcagguuaauuacagccaacccaguuaucacggaaaguaccgaaaauuccaagaugaugcuggagcuagaucccccguucggagacagcuacauagugauuggcgucggggagaaaaagaucacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauucaccagaucuucggagccgcuuuuaaguccuuguucggcgggaugucuugguuuucgcaaauucugauaggaacucuccugauguggcuuggccugaaugcaaagaacgguagcaucuccuugaugugucucgccuuagggggaguucugauuuuccugucaaccgcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6199 - RNA, 2524 nt, Artificial Sequence
  KY075935.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcucaaaggagccggcgcgcagugacacuaccgucccauucuaccagaaagcuccagacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacguggucuuagagcauggcgggugugugaccgugauggcacaagauaagccaacagucgacauagagcugguuaccacgacugugucaaauauggcugaaguacggaguuacugcuaugaggccagcauuucugauauggcguccgacucacguugucccacacagggagaagccuaccuugacaaacagagcgauacccaguaugugugcaagcgcacuuuggucgacagaggcugggguaacggguguggacuguucggcaaaggcagucuagugacaugcgcaaaguuugcuugcucuaagaaaaugaccgggaaguccauccaaccugagaaucucgaauacaggauuaugcugagcguucacggaucgcagcacucugguaugaucgugaacgauacgggccaugagaccgacgagaaucgggccaaagucgaaaucacaccaaacucaccccgagcugaggccacucuugggggauucggcucccuggguuuggauugugaaccucgcaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagagacagaccguugugguccugggcagccaggagggggccgugcauaccgcuuuggccggagcacuagaagccgagauggauggugcuaagggcaggcuguccucugggcaccucaaaugccggcugaagauggacaaacuucgccugaagggagucagcuauucauuguguacugccgcauucacguuuacaaaaauaccugcggaaacccuccauggcacugugaccguugaggugcaauacgcugguacagacgggccaugcaagguacccgcccagauggcagucgauaugcagacccugacuccugugggcagauuaaucacagccaacccaguuauuacggaaaguaccgaaaauuccaagaugaugcuggagcuagaucccccguucggagacagcuacaucgugauaggcgucggggagaaaaagauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaaaggcauccaccaaauuuucggagccgcuuuuaaguccuuguucggcgggaugucuugguuuucgcagauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6200 - RNA, 2524 nt, Artificial Sequence
  KY014320.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaagcccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6201 - RNA, 2524 nt, Artificial Sequence
  KX827309.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaucugacgccggcgaggcaaucucauuccccaccacauuggggaugaauaaaugcuauauucagaucauggauuuaggacacaugugugacgccacuaugaguuacgaaugcccuaugcuggaugagggcguggaaccagacgauguagacuguuggugcaacaccacaagcaccuggguggucuaugguacuugucaucacaagaaaggggaggcuaggcggucccgcagagcagugacacuaccgucucauucgaccaggaagcuccaaacgcggucacagacuuggcuggagagccgcgaauacaccaagcaccuuauucgaguugagaauuggaucuuuagaaaccccggauucgcccuggcugccgcggcaauagccugguugcucggcaguuccacaucucagaaagugaucuaucuggucaugauucugcucaucgcuccugccuacagcauuaggugcaucggcguguccaaucgggauuuuguagaagggaugucaggagguacuuggguugacguggucuuagagcauggcgggugugugaccgugauggcacaggauaagccaacagucgacauagagcugguuaccacgacugugaguaacauggcugaaguacguagcuacugcuaugaggccucuauuuccgauauggcgucagacagccgcugucccacacaaggagaagccuaccuugacaaacagagugauacccaguaugugugcaagagaacuuuggucgacaggggcugggguaauggguguggacuguucggcaaaggcucucuagugacaugcgcaaaguuugcuugcuccaagaaaaugaccgggaaaagcauccagccugagaaccucgaauaccggauuaugcugucgguucacggaucucaacacuccgguaugaucgugaaugauacgggccaugagaccgacgagaaccgagccaaagucgaaaucacaccaaauucaccccgcgcugaggccacucuugggggauucggcagucuggguuuggauugugaaccuagaaccgggcucgacuuuagcgaucuguauuacuuaacaaugaacaauaagcacuggcuggugcauaaagagugguuccacgacauuccacucccguggcacgcaggcgccgauacuggaacaccccauuggaacaauaaggaagcucuuguagaguuuaaagacgcgcacgcaaagaggcagaccguugugguccugggcucccaggagggggccgugcauaccgcuuuggccggagcacuagaagccgagauggauggugcuaagggccggcugucuagcgggcaccucaaaugccgccugaagauggacaaacuuagacugaagggagucucauauaguuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaauccaccgagaacagcaagaugaugcuggagcuagaucccccguucggagacucuuacaucgugauaggcgucggggagaaaaagauuacucaccacuggcaucguucaggaaguacaaucgguaaggcuuuugaagccaccgugcggggcgcaaagcgaauggcuguacucggggacacagccugggauuucggaagcgugggcggugcgcuuaauucccuggggaaaggcauccaccagauuuucggagccgcuuuuaagucuuuguucggcgggaugucgugguuuagccaaauccugauuggaacucuccugauguggcuuggccugaacaccaagaaugguuccauaucauugaugugucucgcauuagggggaguucugaucuuccugaguacggccgucucugcugacgugggcugcagcguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6202 - RNA, 2524 nt, Artificial Sequence
  KU681081.3 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacaccggcgccgauacaggaacuccccauuggaacaauaaggaagcacuuguagaguuuaaagacgcccacgcuaagaggcagaccguugugguccugggcucccaggagggggcggugcauacggcauuggccggagcucuagaagccgagauggauggugcaaagggccggcugucuagcgggcaccucaaaugccgccugaagauggacaaacuuagacugaagggagucucauauaguuuguguacagccgcuuucaccuuuacuaaaauaccugccgaaacccuccauggcacagugaccguugaggugcaguacgcagguacugacgggccaugcaagguacccgcgcaaauggcugucgauaugcagacacugacgccugugggcagguuaaucaccgccaacccaguuauuacugaaggaacagagaacuccaagaugaugcuggagcuagaucccccguucggcgacagcuacaucgugauaggggucggagaaaagaagauuacccaccacuggcaucguucugguucaacaaucggcaaagcauuugaggccacugugcgaggggcuaagcggauggccguacucggagacaccgcaugggauuucggcagugugggugggguucugaauagccuuggcaaaggaauccaccagauuuucggcgcugccuuuaaguccuuguucgggggaaugucuugguuuucgcaaauccugauuggcacgcuccugauguggcuuggucugaacaccaagaaugggagcauauccuugaugugucucgcgcugggaggcgucuuaaucuuccugucaacagccgugagugcugacguggguugcucugucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6203 - RNA, 2524 nt, Artificial Sequence
  KU744693.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgcaauggcucaggauaagccaacaguggacauagagcuggucaccacgacuguuucaaauauggccgaagugcguaguuacugcuaugaggcgagcauuucugauauggccuccgacucacgcugucccacacaaggagaagcauaccuugacaaacagagcgauacccaguauguaugcaagagaacuuugguggacaggggcugggguaacggguguggacuguucggcaaaggcagucuagucacaugcgcuaaguuugccugcucuaagaaaaugaccgggaaguccauccagccugagaaucucgaauaccggauuaugcugagcgugcacggaucgcaacacucugguaugcuuguuaacgauacgggccaugagaccgacgagaaucgagcuaaaguggaaaucacaccaaacucaccccgcgccgaggcaacucugggaggguucggcuccuugggucucgauugugaaccuagaaccgggcuggacuuuagugauuuauauuaccugacaaugaauaacaagcacuggcucgcccauaaagagugguuccacgacaucccacuuccguggcacgcuggcgcggcaacuggaacaccccauuggaauaacaaggaagcccuggucgaguuuaaagaugcucacgccaagaggcagaccgugguaguuuugggcagccaggagggggcagugcauaccgcccuagcuggagcccuggaagcagagauggacggugcgaagggccggcucuccucugggcaccugaaaugccgccuuaagauggauaaacugagauugaagggagucagcuauucacucuguacugcugccuucacguuuacaaaaauuccugcagaaaccguggacggcacugucaccguggagggucaguacgggggcacagacggaccaugcaagguucccgcccaaauggcuguggauaugcagacccugacuccuguaggcagguuaauaacagccaacccagucaucacggaaaguaccgaaaauuccaagaugaugcuggagcuagaucccccguucggggacagcuacauugugaucggaguuggugagaaaaagauaacucaucacuggcaccguucuggcucaacaauugggaaagcauuugaggcuaccgugcggggagccaagcgaauggcgguccucggcgacacagccugggauuucgguaguguagggggcgcucugaacagccuuggaaaaggcauccaucagaucauuggggcagccuucaaguccuuguuuggaggcaugucuugguucucgcaaauccugauugguacucuccugauguggcuugggcugaauaccaagaacggaagcauauccuugaugugucucgcucugggcgguguguuaaucuuucugucaacggccgugaguggcgggguuggaugcucugucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6204 - RNA, 2524 nt, Artificial Sequence
  KY328290.1 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaagucuauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuuccaaaauaccugcagaaacccuccauggcacugugaccgaggaaguucaguacgcggguacagacgggccaugcaaggugcccgcucaaauggccguagauaugcagacccugacuccugucggcagguuaaucacagcaaacccagugauuacggagagcaccgagaacucuaagaugaugcuggaacuagaucccccguucggagacucauacaucguuauaggcgugggggagaaaaagauuacucaccacuggcaucguaguggaagcacaaucgguaaagccuuugaagcuaccguccggggcgccaagcgaauggcagugcucggggacacagcuugggauuucggauccguaggcggugcccugaauagccuugggaaaggcauccaccagauuuucggagcggccuuuaagucguuguucggcgggaugagcugguuuucccaaauccugauuggaacucuccugauguggcuuggccugaacaccaagaaugguucaauaaguuugaugugucucgcuuuagggggagugcugaucuuccugucuacggcaguuagcgccgacgucggcugcuccguggauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6205 - RNA, 2524 nt, Artificial Sequence
  KX694532.2 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugaugugucucgcuuuagggggaguucugaucuuccugaguaccgcagucucugccgacgugggcugcagcguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6206 - RNA, 2524 nt, Artificial Sequence
  KU955593.1 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcaguugaagugacccgacgugguaaugccuacuauauguaccuggauagauccgacgcgggcgaggcuaucucuuuccccacaacuauggggaugaacaaaugcuauauucagaucauggauuugggacacaugugugacgccaccaugucauacgaaugcccuauguuagaugagggcguagaaccagacgauguggacuguuggugcaauacaaccaguacuugggucguguaugguacaugucaucacaagaaaggggaggcaaggcggagccgcagagccguuacccugccgucccauucuacgaggaagcuacaaacucggucgcagaccuggcucgagucacgcgaauacacaaagcaccugauucgaguggagaacuggaucuuuagaaaucccggauucgcucuugcagccgcugccauagcguggcuguugggcagcaguacuucccagaaagucaucuaucucgugaugauucugcugaucgcacccgccuacucuauuaggugcaucggcguaagcaaccgggauuuuguugaagggauguccggagguaccuggguggacgucgugcucgagcauggcgggugugugacagucauggcucaggauaagccaaccguugacauagaguuagugacgacuacaguaucaaauauggccgaagugcguaguuacugcuaugaggcaagcauuucugauauggcuuccgacucacgcugucccacccaaggagaagccuaccuggacaaacagagcgauacucaguaugucugcaagagaacacuuguggacaggggcugggguaacggguguggauuguucggcaaaggcagucugguuaccugcgcgaaguuugccugcucuaagaaaaugacggggaaguccauccagccugagaaucuagaauaccggauuaugcucagcgugcacggaucgcaacacucugguaugaucgucaacgauaccggccaugagacagacgagaaucgagcaaaaguggaaaucacuccaaacuccccucgcgcugaggccacccuugggggauucggcucacugggucuggauugugaaccuagaacaggguuggacuuuagugaucucuauuaccugacuaugaauaacaagcacugguuaguacauaaagagugguuccacgacauuccacugccguggcacgcuggcgccgauaccggaacaccccauuggaauaacaaggaagcacucguugaguuuaaagacgcccacgcuaagaggcagaccguggucgugcuuggcagccaggagggggcgguccauacugcacuggccggagcuuuggaagccgagauggauggugcaaagggccggcuauccucugggcaccugaaaugccgccucaagauggacaaacugagacuuaagggagugagcuauucacuguguacggccgcuuucacauuuaccaaaauaccugccgaaacuuugcauggcaccguuacaguggagguacaguacgcagguaccgacgggccaugcaagguccccgcgcaaauggcuguggauaugcagacucucacaccuguuggcaggcugaucacggccaacccagugauuaccgaaaguacugaaaauuccaagaugauguuagagcuggaucccccguucggagacagcuacaucgucauaggcgugggggagaaaaagauuacacaccacuggcaucguucuggaucaaccaucgguaaagcauuugaggccacaguacggggcgcuaagcgaauggccgugcuaggggacacugcaugggauuucggaaguguuggcggugcucucaacagccuggggaaaggcauccaccagauuuucggagccgcguuuaagucccuuuucggcgggaugucuugguuuucgcaaaucuugauuggaacccugcucgucuggcugggccuuaauacgaagaacgguagcauaucccugauguguuuggcccucgggggagugcugaucuucuuaucaaccgcugugagugcagacgucggcugcucuguugauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6207 - RNA, 2524 nt, Artificial Sequence
  KY272987.1 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugguuugucucgcuuuagggggaguccugaucuuccugaguaccgcagugucugccgacgugggcugcagcgucgauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6208 - RNA, 2524 nt, Artificial Sequence
  EU545988.1 prME-long mRNA Design 2 opt
ggggcgcugccuacggagguggcagccaucuccuucucggcaucaagcuuaccaugagaaucauuaacgccaggaaggagaaaaagcggcgcggcaccgacacaagcguggggauagucggacugcuccuuacuacggcuauggcaguugaagugacccgacgugguuccgccuacuauauguaccuggauagaucugacgcgggcgaggcuaucucauuccccacaacuuuggggaugaauaaaugcuauauucagaucauggauuuaggacacaugugugacgccaccaugaguuacgaaugcccuaugcuggaugagggcguagaaccagacgauguggacuguuggugcaacacaaccagcacuugggucguguaugguacaugucaucacaagaaaggggaggcaaggcggucccgcagagccguuacccuaccgucucauucgacgaggaagcuccaaacucggucacagaccuggcuggagagccgcgaauacacaaagcaccuuauucgaguggagaauuggaucuuuagaaaccccggauucgcucuggcagccgcugccauagcgugguugcucggcaguuccacuucucagaaagucaucuaucuggugaugauucugcucaucgccccugcauacagcauuaggugcaucggcguauccaaucgggauuuuguugaagggaugucaggagguaccuggguggacgucguguuagagcauggcgggugugugacagucauggcucaggauaagccagccguugacauagagcuggugaccacgacuguaaguaacauggcagaagugcguagcuacugcuaugaggcuucuauuuccgauauggccucagacagccgcugucccacacaaggagaagcguaccuugacaaacagagugauacccaguaugucugcaagagaacuuugguggacaggggcugggguaauggguguggacuguucggcaaaggcucucuaguuacaugcgccaaguuugcaugcuccaagaaaaugaccgggaaaagcauccagccugagaaccucgaauaccggauuaugcugucggugcacggaucucaacacuccgguaugaucgucaaugauacgggccaugagaccgacgagaaccgagcuaaaguggaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguacauaaagagugguuccacgacauuccacucccguggcacgccggcgcagauacuggaacaccccauuggaacaauaaggaagcccuuguugaguuuaaagacgcucacgcgaagaggcagaccguggucgugcugggcucccaggagggggcaguccauaccgccuuggcuggagcccuagaagcagagauggauggugccaagggccggcugucuagcgggcaccucaaaugccgccugaagauggacaaacuuagacugaagggagugucauauaguuuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaauccaccgagaacagcaagaugaugcuggagcuagaucccccguucggagacucuuacaucgucauaggcgugggggaaaagaagauuacucaccacuggcaucguucaggaaguacaaucgguaaagccuuugaggcuaccguacggggcgccaagcgaauggcagugcucggggacacagcuugggauuucggaagcguuggcggugcccuuaauucccuggggaaaggcauccaccagauuuucggagcggccuuuaagucuuuguucggcgggaugucgugguuuagccaaauccugauuggaacucuccuggucuggcuuggccugaacaccaagaaugguuccauaucauugacgugucucgcuuuagggggagugcugaucuuccugaguaccgcagugucugccgacgucggcugcagcguugauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6209 - RNA, 2524 nt, Artificial Sequence
  KU681082.3 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggaugaauaaaugcuauauucagaucauggauuuaggacacaugugugacgcaacuaugaguuacgaaugcccuaugcuggaugagggcguagaaccagacgauguggacuguuggugcaacaccacaagcaccugggucguguaugguacuugucaucacaagaaaggggaggccaggcggucccgcagagcuguuacacuaccgucucauucgaccaggaagcuccaaacgcggucacagacuuggcuggagagccgcgaauacaccaagcaccuuauucgaguggagaauuggaucuuuagaaaccccggauucgcacuggccgcugccgucauagcgugguugcucggcaguuccacaucucagaaagugaucuaucugguaaugauucugcucaucgccccugcauacagcauuaggugcaucggcguuuccaaucgggauuuuguggaagggaugucaggagguacuugggucgacgugguguuagagcauggcgggugugucaccguuauggcucaggauaagccaacaguggacauagagcugguaaccacgacugugaguaacauggccgaaguccguagcuacugcuaugaggcaucuauuuccgauauggcuucagacagccgcugucccacacaaggagaagccuaccuugacaaacagagugauacccaguaugugugcaagagaacuuugguugacaggggcugggguaauggguguggacuguucggcaaaggcucucuagugacaugcgcgaaguuugccugcuccaagaaaaugaccgggaaaagcauccagccugagaaccucgaauaccggauuaugcugucgguccacggaucucaacacuccgguaugaucgugaaugauacgggccaugagaccgacgagaaccgagcaaaaguagaaaucacaccaaauucaccccgcgcugaggccacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgcuggcgccgauacuggaacaccccauuggaacaauaaggaagcacuuguggaguuuaaagacgcccacgcuaagaggcagaccgucgugguccugggcucccaggagggggcggugcauaccgcauuggccggagcucuagaagccgagauggauggugcaaagggccggcugucuagcgggcaccucaaaugccgccugaagauggacaaacuuagacugaagggaguuucauauaguuuguguacugccgcuuucacguuuacaaaaauaccugccgaaacccuccauggcacugugaccguagagguccaguacgcagguacagacgggccaugcaaggugcccgcgcaaauggcuguugauaugcagacccugacuccugugggcagguuaaucacagccaacccagucauuacggaauccaccgagaacagcaagaugaugcuggagcuagaucccccguucggagacucuuacaucgugauaggcguaggggaaaagaagauuacucaccacuggcaucguucaggaaguacaaucgguaaagcauuugaggccaccgugcggggcgcuaagcgaauggccguucucggggacacagcaugggauuucggaagcgucggcggugcucuuaauucccuggggaaaggcauccaccagauuuucggagccgcguuuaagucuuuguucggcgggaugucgugguuuagccaaauccugauuggaacucuccugguguggcuuggccugaacaccaagaaugguuccauaucauugacgugucucgccuuagggggagugcugaucuuccugaguaccgcugucucugcagacguuggcugcagcguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6210 - RNA, 2524 nt, Artificial Sequence
  KX601167.1 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggguaaauaaaugcuauauucagaucauggauuuaggacacaugugugacgcaacuaugaguuacgaaugcccuaugcuggaugagggcguggaaccagacgaugucgacuguuggugcaacaccacaagcaccugggugguuuaugguacuugucaucacaagaaaggggaggccaggcggucccgcagagcugugacacuaccgucucauucgaccaggaagcuccaaacgcggucacagacuuggcuggagagccgcgaauacaccaagcaccuuauucgagucgagaauuggaucuuuagaaaccccggauucgcacuggccgcugccgcgauagcaugguugcucggcaguuccacaucucagaaagugaucuaucugguaaugauucugcucaucgccccugcuuacagcauuaggugcaucggcguuuccaaucgggauuuuguggaagggaugucaggagguacuugggucgacgugguguuagagcauggcgggugugucaccguuauggcccaggauaagccaacaguggacauagagcugguaaccacgacugugaguaacauggcagaaguccguagcuacugcuaugaggcuucuauuuccgauauggccucagacagccgcugucccacacaaggagaagcguaccuugacaaacagagugauacccaguaugugugcaagagaacuuugguugacaggggcugggguaauggguguggacuguucggcaaaggcucucuagugacaugcgccaaguuugcaugcuccaagaaaaugaccgggaaguccauccagccugagaaccucgaauaccggauuaugcugucgguccacggaucucaacacuccgguaugaucgugaaugauacgggccaugagaccgacgagaaccgagcuaaaguagaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgccggcgcagauacuggaacaccccauuggaacaauaaggaagcccuuguggaguuuaaagacgcucacgcgaagaggcagaccgucgugguccugggcucccaggagggggcagugcauaccgccuuggcuggagcccuagaagcagagauggauggugccaagggccggcugucuagcgggcaccucaaaugccgccugaagauggacaaacuuagacugaagggaguuucauauaguuuguguacugcugccuucacguuuacaaaaauaccugcagaaacccuccauggcacugugaccguagagguccaguacgcggguacagacgggccaugcaaggugcccgcucaaauggccguugauaugcagacccugacuccugugggcagguuaaucacagcaaacccagucauuacggaauccaccgagaacagcaagaugaugcuggagcuagaucccccguucggagacucuuacaucgugauaggcguaggggacaaaaagauuacucaccacugguaucguucaggaaguacaaucgguaaagccuuugaagcuaccgugcggggcgccaagcgaauggcaguucucggggauacagcuugggacuucggaagcgucggcggugcccugaauagccuugggaaaggcauccaucagauuuucggagcggccuuuaagucuuuguucggcgggaugucgugguuuagccaaauccugauuggaacucuccugguguggcuuggccugaacaccaagaaugguuccauaucauugacgugucucgcuuuagggggagugcugaucuuccugaguaccgcagucucugccgauguuggcugcagcguggacuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6211 - RNA, 2524 nt, Artificial Sequence
  KX694533.2 prME-long mRNA Design 2 opt
ggggcgcugccuacggagguggcagccaucuccuucucggcaucaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcaaagccaucucauuccccaccacauuggggguaaauaagugcuauauucagaucauggauuuaggacacaugugugacgcaacuaugaguuacgagugcccuaugcuggaugaaggcguggagccagacgaugucgacuguuggugcaacaccacaagcaccugggugguuuaugguacuugucaucacaaaaagggggaagccaggcggucccgcagagcugugacacuaccgucucauucgaccaggaagcuccaaacgcggucacagacuuggcuggagagccgcgaguacaccaaacaccuuauucgagucgaaaauuggaucuuuagaaaccccggauucgcacuggccgcugccgcgauagcaugguugcucggcaguuccacaucucagaaggugaucuaucugguaaugauucugcucaucgccccugcuuacagcauuaggugcaucggcguuuccaaucgggauuuuguggaggggaugucaggagguacuugggucgacgugguguuagaacauggcgggugugucaccguuauggcccaggauaaaccaacaguggacauagagcugguaaccacgacugugaguaacauggcagagguccguagcuacugcuaugaggcuucuauuuccgauauggccucagacagccgcugucccacacaaggagaagcguaccuugacaagcagagugauacccaguaugugugcaaaagaacuuugguugacaggggcugggguaauggguguggacuguucggcaagggcucucuagugacaugcgccaaguuugcaugcuccaaaaagaugaccgggaaaagcauccagccugaaaaccucgaguaccggauuaugcugucgguccacggaucucaacacuccgguaugaucgugaaugauaucggccaugaaacggacgagaaccgagcuaagguagagauuaccccaaauucaccccgcgccgaagcuacacuugggggauucggcagucuggguuuggauugugagccuagaacugggcucgacuuuagcgaucuguauuacuuaaccaugaacaauaaacacuggcugguucauaaggaaugguuccacgacauaccacucccguggcacgccggcgcagauacaggaacuccccauuggaacaauaaagaggcccuuguggaauuuaaggacgcucacgcgaagaggcagaccgucgugguccugggcucccaggagggggcagugcauacagccuuggcuggagcccuagaggcagaaauggauggugccaaaggccggcugucuagcgggcaccucaagugccgccugaaaauggacaagcugagacugaaaggaguuucauauaguuuguguaccgcugccuucacuuuuacgaagaucccugcagagacacuccauggcaccgugacuguagaaguccaguacgcggguaccgacgggccaugcaaggugcccgcucaaauggccguugauaugcagacacugaccccugugggcagguuaauuacugcaaacccagucaucacagaguccacggaaaacagcaaaaugaugcuggagcuagaucccccguucggagacucuuacauagugauuggcguaggggacaagaaaaucacccaccacuggcaucguucaggaaguacuaucgguaaggccuuugaggcuacagugcggggcgccaaacgaauggcaguucucggggauaccgcuugggacuucggaagcgucggcggugcccuuaauucccuugggaagggcauucaccagaucuucggagcggccuuuaagucuuuguucggcgggaugucgugguuuagccaaauucugauaggaacacuccugguguggcuuggccugaacacuaaaaaugguuccaucucauugaccugucucgcuuuagggggagugcugauuuuccugaguacggcagucucugccgauguuggcugcagcguggacuuuuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6212 - RNA, 2524 nt, Artificial Sequence
  KY288905.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugauacaggccacgaaacugacgagaaccgagccaagguagagguuaccccuaauucaccacgcgcagaagcuacacuugggggauucggcagucuggguuuggauugugagcccagaacugggcucgacuuuagcgaucuguacuauuuaaccaugaacaauaaacauuggcuggugcacaaggaaugguuccacgacauuccucucccauggcaugccggcgcugauacaggaaccccgcacuggaacaauaaagaggcccuugucgaauuuaaggacgcacaugccaagaggcagacuguggucgugcugggcucccaggagggggcuguucacacggcguuggcaggagcccuagaggcugaaauggauggugccaaaggccggcuguucucugggcaucucaagugccgccugaaaauggacaaacuuagacugaagggagugagcuacucauuguguacagcagccuuuaccuucacuaagguacccgcugagacccuccacggcacagucaccguggaaguucaguaugccgguacugacgggccuugcaaggugccagcacaaauggcggucgauaugcagacacugacgcccgugggcagguuaauaaccgcuaacccuguaaucacugagaguacagaaaacuccaaaaugaugcuggagcuagacccacccuuuggagauagcuacauugugaucggcguuggggacaagaaaauaacccaccauuggcaccguucuggaucaacaauugguaaggccuucgaggcaacuguccggggcgccaaacgaauggcugugcucggggauaccgccugggacuucggaagugugggcggugucuuuaauagccuggggaagggcauccaucagaucuucggagcagcuuuuaagucccuuuucggcgggaugucuugguuuucgcaaauuuugaucggaacgcugcucguuuggcugggccuuaacaccaaaaaugguagcauuucccugacauguuuggcccucgggggagugaugauauuccugucaacugcggugagugccgauguaggcugcucugucgacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6213 - RNA, 2524 nt, Artificial Sequence
  KF268950.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgauauaggccacgaaacggacgagaaucgagcuaaggucgaggugaccccuaacucaccacgcgccgaagcuacacuugggggauucggcagucuggguuuggauugugagcccagaacugggcucgacuuuagcgaucuguacuauuuaaccaugaauaacaaacauuggcugguacacaaggaaugguuccacgacaucccucucccauggcaugccggcgcagauacaggaacuccgcacuggaauaacaaagaggcccuuguugaauuuaaggacgcucaugcgaagaggcagaccguggucgugcugggcucccaggagggggcaguccacacagccuuggcuggagcccuagaggcagaaauggauggugccaaaggccggcuguucucugggcaucucaagugccgccugaaaauggacaaacuuagacugaagggagugagcuacucauuguguaccgcugccuuuacuuucacgaagguucccgcagagacacuccacggcaccgugacuguagaaguccaguaugcggguaccgacgggccuugcaaggugccagcucaaauggccguugauaugcagacacugacccccgugggcagguuaauuacugcaaacccugucaucacagagaguacggaaaauuccaaaaugaugcuggagcuagacccacccuuuggagauagcuacauagugauuggcguaggggacaagaaaaucacccaccauuggcaccguucuggaucaacuaucgguaaggccuucgaggcuacagugcggggcgccaaacgaauggcaguucucggggauaccgcuugggacuucggaagugucggcgguguguuuaacagccuggggaagggcgugcaucagauuuucggagccgcguuuaagucccuuuucggcgggaugucuugguuuucgcaaaucuugauuggaacacugcucgucuggcugggccuuaauacuaaaaacgguagcauaucccugaccuguuuggcccucgggggaguuaugaucuuccugucaacggcugugagugcagaugugggcugcucuguagacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6214 - RNA, 2524 nt, Artificial Sequence
  KF383121.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauauaggccacgaaaccgacgagaaccgagcaaagguggagguaacaccuaauucaccacgcgcugaagccacucuugggggauucggcagucuggguuuggauugugagcccagaaccgggcucgacuuuagcgaucuguacuauuuaacaaugaacaauaaacauuggcugguucacaaggaaugguuccacgacaucccucucccauggcaugcuggcgccgauacuggaaccccgcacuggaacaauaaagaggcacuuguggaauuuaaggacgcccaugcuaagaggcagacagucgugguccugggcucccaggagggggcggugcacaccgcauuggccggagcucuagaggccgaaauggauggugcaaaaggccggcuguucucugggcaucucaagugccgccugaaaauggacaaacuuagacugaagggaguuagcuacucauuguguacugccgcuuuuacguucacaaaggugcccgccgagacccuccacggcacuguaaccgucgaagugcaguaugcagguacagacgggccuugcaagguuccagcgcaaauggcuguggauaugcagacccugacucccgucggcagguuaauuacagccaacccugugaucacggagaguaccgaaaacuccaaaaugaugcuggagcuagacccacccuuuggagauagcuacauaguaauuggcgugggggacaagaaaaucacucaccauuggcaccguucuggaucaacaaucgguaaggcauucgaggccaccguucggggcgcuaaacgaauggccguccucggggauacagcaugggacuucggaagugugggcgguguguuuaauagccuggggaagggcauucaucagaucuucggagcugccuuuaagucccuuuucggcgggaugucuugguuuucgcaaauuuugauaggaacucugcucgucuggcugggccuuaacaccaaaaaugguagcaucucccugacguguuuggcgcucgggggaguuaugauuuuccugucaaccgccgugagugcugaugugggcugcucuguagacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6215 - RNA, 2506 nt, Artificial Sequence
  KF268949.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgaugaaaaucgagcuaaggucgaggugacgccuaacucaccacgcgccgaggcuacccuuggcggguucggaagucugggcuuggacugugaacccagaacaggucucgauuuuagcgaccuguacuauuuaacuaugaauaacaaacacuggcugguacauaaggagugguuccacgauauaccucucccauggcacgccggggcagacaccggcacaccgcauuggaauaacaaagaagcccuuguugaguuuaaggaugcucacgcgaagaggcagacuguggucgugcugggaucccaggaaggcgcaguccauaccgccuuggcuggggcccuagaggcagagauggacggagccaaaggucggcuguucucuggccaccucaagugccgccugaaaauggauaaacuuagacugaaaggggugagcuacucauuguguacagcugccuuuaccuucacuaagguucccgcagaaacgcuccauggaacagugaccguagagguccaguaugcgggcacugacgguccuugcaaggugccagcucaaauggccguugacaugcagacccugacacccguggggagguuaaucaccgcaaacccugucauuacugaaaguacagaaaauuccaaaaugaugcuggagcuagauccacccuuuggcgacagcuacaucgugauaggaguaggcgauaagaaaauuacgcaccacuggcaucguucugggucaaccaucggaaaggccuucgaggcuacugugcggggugccaaacgaauggcaguucucggcgacacagcuugggauuucgggagugucggaggcguguuuaacagccuggguaaggggauccaccagauuuucggcgccgcguuuaagucccuuuucggaggcaugucuugguuuucgcaaaucuugauugggacccugcucguguggcugggacuuaauacaaagaacggcagcauaucccugacuuguuuggcccucgguggggucaugaucuuccugucaaccgcuguuagugcagacgugggaugcucuguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6216 - RNA, 2524 nt, Artificial Sequence
  KU955595.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugauaccggccacgaaacagacgagaaccgagcaaagguagagguuacuccuaauucaccacgcgcugaagccacccuugggggauucggcagucuggguuuggauugugagcccagaacagggcucgacuuuagcgaucuguacuauuuaacuaugaacaauaaacauuggcuggugcacaaggaaugguuccacgacauuccucucccauggcaugcuggcgccgauaccggaacaccgcacuggaacaauaaagaggcacuugucgaauuuaaggacgcccaugcuaagaggcagaccguggucgugcugggcucccaggagggggcgguucacacugcauuggccggagcucuagaggccgaaauggauggugcaaaaggccggcuguucucugggcaucucaagugccgccugaaaauggacaaacuuagacugaagggagugagcuacucauuguguacggccgcuuuuacauucaccaagguacccgccgagacucuccacggcaccgucacaguggaaguucaguaugcagguaccgacgggccuugcaaggugccagcgcaaauggcugucgauaugcagacucugacacccgugggcagguuaauaacggccaacccuguaaucaccgagaguacugaaaacuccaaaaugaugcuggagcuagacccacccuuuggagauagcuacauugugaucggcguuggggacaagaaaauaacacaccauuggcaccguucuggaucaaccauugguaaggcauucgaggccacaguccggggcgcuaaacgaauggccgugcucggggauacugcaugggacuucggaagugugggcggugucuuuaauagccuggggaagggcauccaucagaucuucggagcugccuuuaagucccuuuucggcgggaugucuugguuuucgcaaauuuugaucggaacccugcucguuuggcugggccuuaacacgaaaaaugguagcauuucccugaccuguuuggcgcucgggggagugaugauauuccugucaacagccgugagugcugauguaggcugcucugucgacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6217 - RNA, 2524 nt, Artificial Sequence
  KF383116.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaacacaagaaaggggaagcacggcgcuccagaagggccgugacacuaccaucucauucgacccggaagcuccagacgcgcucacagacuuggcuggagagccgagaguauaccaagcaccuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacauggcgggugugucaccguuauggcccaagauaaaccuacaguggacauugagcugguaaccacgacugugaguaacauggcagagguccguagcuacugcuacgaggcuucuaucuccgauauggccucagacagccgcuguccaacacagggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucaacccgaaaaccucgaguaucggaucaugcugucgguccacggaucucagcacuccgguaugaucgugaaugauauuggccaugaaaccgacgagaaccgagcaaagguagagguuacaccuaauucaccacgcgcugaagccacucuugggggauucggcagucuggguuuggauugugagcccagaaccgggcucgacuuuagcgaucuguacuauuuaacaaugaacaauaaacacuggcuggugcauaaggaaugguuccacgacauaccucucccauggcacgcuggcgccgauacuggaaccccgcauuggaacaauaaagaggcacuugucgaauuuaaggacgcccacgcuaagaggcagacaguggucgugcugggcucccaggagggggcgguucauaccgcauuggccggagcucuagaggccgaaauggauggugcaaaaggccggcuguucucugggcaccucaagugccgccugaaaauggacaaacuuagacugaagggagugagcuacucauuguguacugccguaugcacggcugccaagguccccgcagagacacuccauggcaccgugacuguugaagugcaauaugcggguaccgacgggccuuguaaggucccagcucagauggccguggauaugcagacacugacccccguaggcagguuaaucacugcaaacccugugauuacagagaguacggaaaacuccaaaaugaugcuggagcuagacccacccuuuggagauagcuacaucguuauaggcgucggggacaagaaaauuacccaccacuggcaucguucuggaucaacuaucgguaaggccuucgaggcuacagugcggggcgccaaacgaauggcagugcucggggauaccgcuugggacuuuggaagugucggcgguguuuucaauagccuggggaagggcauccaccaaauuuucggagccgcguuuaagucccuuuucggcgggaugucuugguuuucgcagaucuugauuggaacacugcucguguggcugggccuuaacacuaaaaaugguagcauaucccugaccugcuuggcccucgggggagugaugaucuuccugucaacggcuguaagugcagaugucggcuguucuguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6218 - RNA, 2506 nt, Artificial Sequence
  KU963574.2 prME-long mRNA Design 2 opt
ggggcgcugccuacggagguggcagccaucuccuucucggcaucaagcuuaccaugagaaucauuaacgccaggaaggagcggaaacgccgaggcgcugacgcaagcauagggaucgugucccugcuccuuaccacagucauggccgcggaaauuacucguagaggaucugcuuacuauauguaccuggauaggucagacgccgguaaggcaaucaguuucguuacgaccuugggcgugaauaaaugccacguacagauuauggauuuagggcauaugugugacgccacaaugagcuaugagugccccaugcuggaugaaggaguggagccugacgaugucgacuguuggugcaacacuaccuccacaugggugguuuacggcaccugucaccauaagaaaggugaagcucggcgcucuagaagggcagugacucuaccaucgcacucaacacggaagcuccaaacccgcagccagacguggcuggagagucgagaguauacuaagcaucuuaucaaagucgaaaauuggauauuuagaaacccgggguucgcccugguggcuguagccaucgcgugguugcucggauccucuaccagccagaagguuauuuaccuggugaugauccugcucauugcacccgccuauuccaucaggugcauaggcgucucaaaucgggauuuuguggagggcaugagugggggaacauggguggacgucguuuuagaacacgguggcugugugacuguaauggcucaggauaaaccuaccguggacauugagcuggucacaaccacggugagcaacauggccgagguucguucuuacugcuacgaagcauccaucucagauauggcuagcgacagucgcuguccaacucaaggggaggccuaucuugacaagcagucugauacacaguacgugugcaaaagaaccuuggucgacaggggauggggcaaugguugugggcuguucggaaagggcucccuagugacuugcgcgaaguuuacaugcagcaaaaagaugaccggcaaaucgauucagcccgaaaaccucgaguaucggaucaugcugucuguacacgggucccaacauucaggaaugaucguuaaugaugaaaaccgagccaagguggaggucacgccuaauaguccacgcgcagaggcuacccuugguggcuucgggagccugggauuggacugugaacccagaacaggccucgauuuuuccgaccuguacuauuuaacuaugaacaauaaacacuggcuggugcauaaggagugguuccacgauauuccucucccauggcacucuggugccgacaccgaaacaccgcauuggaacaauaaagaggcucuugucgaauuuaaggaugcccacgcaaagaggcagacugugguugugcuggggagccaggagggcgccguacauaccgcuuuggcgggagcacuagaggccgaaauggacggcgcuaaagggcggcugucaaguggacaccucaagugccgccugaaaauggauaaacuuagacugaaaggugucuccuacagcuuguguacagccgcauucaccuuuacuaaggugcccgccgagacgcuccauggcacaguuaccguggaaguccaguaugcugggagggacggaccuugcaaggugccagcccaaauggcaguagacaugcagacucugacccccgugggccguuuaauaacagcgaacccuguuaucaccgagucuacugaaaacucaaaaaugaugcuggagcuagauccacccuucggugacaguuacauugucaucggggugggcgauaagaaaauaacacaccacuggcaucggagcggauccauuaucggcaaggcuuuugaggccacggugcgaggggcaaaaagaauggccguccucggagacaccgcuugggauuucgguucuguuggcgggguguucaauucgcugggaaagggcauccaccagauuuuuggugccgcauucaagagccuuuuugggggcauguccugguucucacaaaucuugauuggaacucugcucguguggcugggccuuaacacaaagaaugggaguauaucucugaccuguuuggcucucggaggcguaaugaucuuucugagcacagccgucuccgcggacguggguugcucaguugauuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6219 - RNA, 2506 nt, Artificial Sequence
  KX601166.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugaugaaaaccgagcaaagguagagguuaccccuaauucaccacgcgcugaggccacacuuggcggguucggaagucugggcuuggacugugaacccagaacuggucucgauuuuagcgaccuguacuauuuaaccaugaacaauaaacacuggcuggugcauaaggagugguuccacgauauuccucucccauggcacgcuggggccgacacaggcacuccgcauuggaacaauaaagaagcacuugucgaguuuaaggaugcccacgcuaagaggcagaccguggucgugcugggaucccaggaaggcgcgguucauacagcauuggccggggcucuagaggccgagauggacggagcaaaaggucggcuguucucuggccaccucaagugccgccugaaaauggauaaacuuagacugaagggggugagcuacucauuguguaccgccgcuuuuacuuucacgaagguacccgccgaaacacuccauggaaccgucacuguggagguucaguaugcaggcaccgacgguccuugcaaggugccagcgcaaauggcugucgacaugcagacacugacccccguggggagguuaauaacugccaacccuguaaucacagaaaguacggagaacuccaaaaugaugcuggaacuagauccacccuuuggcgacagcuacauugugaucggaguuggcgauaagaaaauaacccaccacuggcaucguucugggucaacuauuggaaaggcauucgaggccacaguccggggugcuaaacgaauggccgugcucggcgacaccgcaugggauuucgggagugugggaggcgucuuuaauagccuggguaaggggauccaccagaucuucggcgcugccuuuaagucccuuuucggaggcaugucuugguuuucgcaaauuuugaucgggacacugcucguuuggcugggacuuaacacuaaaaauggcagcauuucccugaccuguuuggcgcucgguggggugaugauauuccugucaacggccgugagugcugacguaggaugcucugucgauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6220 - RNA, 2524 nt, Artificial Sequence
  KF383118.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaaacacggcgcuccagaaggucugucucgcuacgguaucacuacacccgcaagcuccaaacgcgaucacagacuuggcuggagagcagagaguauaagaaacaucuuauaaugguggaaaauuggaucuuuaggaacccaggauucgcaauuguuaguguggccaucaccuggcugaugggcuccuugacaucucagaaggucauuuaccucgugaugaucguacugauaguuccggcuuacagcauuuccugcaucggcgugucaaaucgggaucuggucgaggggaugaguggagguacuuggguggacgugguccucgaacacggcggguguguuaccgagauggcccaggauaaacccacaguggacauugaguuaguaaccaugacggugagcaacauggcggaaguccguucuuauugcuacgaggcaucccugucagauauggccagcgcuagucgcuguccuacucaaggagaaccaucucuugacaagcaguccgacacacagagcgugugcaaaagaaccuugggcgauagggguugggggaauggauguggcaucuuuggcaaggggucgcugguuacuugcucuaaguucacaugcuguaaaaagaugcccggaaaauccauccagccugagaaccuagaauaucggauuaugcucccagugcacgguucacaacauaguggcaugauagucaaugacaucgggcacgagaccgaugagaaccgagccaagguggaaguaacgcccaauagcccucgcgcagaggcuacccugggaggcuuugguucccuugggcuggacugcgaaccaagaacaggcuuggauuucucugaccucuacuaucugacuaugaacaauaaacauugguuaguucacaaggagugguuucacgauauuccgcugcccuggcaugccggagcggacaccggcacaccucacuggaacaauaaagaagcccucguggaguucaaggaugcacaugcuaagaggcagacugucgugguccuugggagccaggagggagccgugcacaccgcucuggccggugcauuggaagccgagauggacggcgcuaaagggcggcuauuuucaggacaucugaagugucgccucaaaauggauaagcugagacuuaaaggcguuaguuacucccugugcacagcggcauucaccuuuacuaaggugccagccgaaacguugcacgguacaguaaccgucgaggugcagagcgcugggacugacggccccuguaagguuccugcccaaauggcaguggacaugcagacccucacaccagucggaaggcugaucaccgccaaccccgugauaacugaaucuacagagaacucaaaaaugauguuagagcuggauccgccuuucggcgacaguuauauuguaaucggggugggagauaagaaaaucacgcaccauuggcaccguagcgguuccaccauuggcaaggcuuuugaagccacuguucgaggggcaaaacggauggcgguccuaggagacacagcuugggauuucggcucugugggugggguguucaauucgcucggcaagggaauccaucagauuuuuggcgccgcauucaagagccuguuugggggaauguccugguucucacaaauacuuaucggcaccuugcuggucuggcucggucugaacacuaaaaaugggaguauuucucuuacaugccuggccuugggaggcguuaugaucuuucucagcaccgcuguguccgccgacguggguuguucaguagauuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6221 - RNA, 2518 nt, Artificial Sequence
  KF383120.1 prME-long mRNA Design 2 opt
ggggcgcugccuacggagguggcagccaucuccuucucggcaucaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacaaugggggugaauaaaugccacguccagaucauggauuugggacauaugugugacgcuacuaugaguuaugagugccccauguuagaugaaggcguugagccugacgauguggacuguuggugcaacaccacaagcaccuggguaguguacgguacuugucaccauaagaaaggggaagcacggccaucccgcagagccgucacacugccgucucacucgaccaggaagcuacaaacgcggucacagacuuggcucgagagccgcgaguauaccaagcaucugauaaaaguggaaaauuggauccuucgaaaccccggauuuacaguugcugcccuggcgauggcaugguugcucggcaauaguacuucccagagagugauuuaccuggucaugauccugcucauugccccugcuuauucuaucaggugcauaggcgugagcaaccgggauuucguagaggggauguccggagguaccuggguugacguggucuuagaacacggcgggugugugacagugauggcccaggauaagccaaccgucgacauugagcugguuacgacuacagugucaaauauggcagagguacguaguuacugcuacgaagcuagcaucucugauauggccuccgacucacgcugucccacccaaggagaggcguaucuugacaaacagagcgauacucaguacgugugcaagagaacauuggucgacaggggcugggguaacggguguggacuguuuggcaaaggcagucuagugaccugcgccaaguucacgugcucuaagaaaaugaccgggaaguccauucagccugaaaaucucgaguaucggaucaugcugagcguucacggaucgcaacauucugguaugaucgugaacgauauuggccacgaaacagacgagaaucgagcaaaagucgaggugacuccaaacucaccccgcgcugaagccacccuugggggauuuggcucccuggguuuggauugugagccuagaacagggcucgacuucagugaucuguacuauuuaacuaugaauaacaagcauuggcugguacacaaagaaugguuucacgacauaccacucccguggcaugcuggcgccgauaccggaacaccccacuggaauaacaaggaggcacuuguugaguucaaagacgcccaugcuaagaggcagaccguggucgugcugggcagccaggaaggggcgguccacacugcauuggccggagcucuagaggccgaaauggauggugcaaagggccggcuguuuuccgggcaucucaaaugccgcaucaagauggacaaacugagacuuaagggagugucuuacagccuguguacggccgcuuucacauuuucaaaaguuccugccgagaccuugcacggcacugugaccguagaaguccaguaugcagguagggacgggccaugcaaggugcccgcgcaaauggcuguugauaugcagacacucaccccugugggccgucugauuacugccaacccaaucauaacagagaguacggaaaauucccggaugauguuagagcuggaucccccguucggagacagcuacauugucaucggcgugggggacaagaaaaucacccaccauuggcaccgaucuggaucaacuauugguaaggcauuugaggccacaguaagaggcgcuaaaaggauggccgugcuaggggauaccgcaugggacuucggaaguguuggcggugucuucaacagccucgggaagggcgugcaucagguguuuggagcugccuucaaaucccuguuuggcgggaugucuugguucucgcaaauccuuauuggaacauugcuggucuggcucggccugaauacuaagaacgguagcauaucccuugcgugucuggcccucgggggagcuaugaucuuuuugucaaccgcaguuagugccgaugugggcugcucuguggacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6222 - RNA, 2449 nt, Artificial Sequence; identical to SEQ ID NO: 6057
  KU321639.1 prME-short mRNA Design 2 opt

SEQ ID NO: 6223 - RNA, 2449 nt, Artificial Sequence; identical to SEQ ID NO: 6058
  KU312312.1 prME-short mRNA Design 2 opt

SEQ ID NO: 6224 - RNA, 2437 nt, Artificial Sequence; identical to SEQ ID NO: 6059
  AY632535.2 prME-short mRNA Design 2 opt

SEQ ID NO: 6225 - RNA, 2449 nt, Artificial Sequence; identical to SEQ ID NO: 6060
  KU527068.1 prME-short mRNA Design 2 opt

SEQ ID NO: 6226 - RNA, 2449 nt, Artificial Sequence
  KX421193.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaccgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6227 - RNA, 2449 nt, Artificial Sequence
  KX377335.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccgcaagaaaggugaggcccgacguuccagaagggcugucacacuaccaucucauucgacccggaagcuccaaacgcgcucacagacuuggcuggaaagcagagaguauaccaaacaccuuauuaagguggagaacuggaucuuuaggaauccgggguucgcacugguugccguggcuauagccugguugcucggaaguuccacaucucagaaggucaucuaccuggugaugauucugcucaucgcgcccgcauauagcauucggugcaucggcguauccaaccgcgacuuuguugaaggcaugucagggggaacuuggguggaugucguguuagagcaugguggcugugugaccgucauggcccaggacaaaccuacaguugauauagaacuggugaccacgacuguaaguaauauggcugaggugcgaagcuacugcuacgaggccucuauuuccgacauggcaucagauagcagauguccaacacaaggggaggcuuaucuugacaagcagagugacacccaguacgucugcaaaaggacuuugguggaucggggauggggcaacgguugugggcuguucggaaagggcucucuaguuacaugcgccaaauuuaccugcuccaagaagaugacgggcaaaagcauccagcccgaaaaucucgaauaucguauuaugcugucggugcacgggucucaacacuccggaaugaucgucaacgacaccgguuacgagacagaugaaaaucgcgcgaagguggagguaacuccuaacucaccaagagccgaggcaacccuuggcggguucggaagucugggcuuggacugugaacccaggacaggucucgauuuuagcgaccuguauuacuuaacuaugaauaacaaacauuggcugguucacaaggagugguuccaugauaucccucucccauggcacgcuggggccgacaccggcacaccgcacuggaauaacaaagaagcucuuguggaguuuaaggaugcccaugcaaaacggcagaccgucgugguccugggaucccaggaaggcgccgugcacacugcuuuggcgggggcacuagaggccgagauggacggagcuaaggguaagcuguucucuggccaucucaaaugccgacugaagauggauaaacuucgccugaaggggguuagcuauucauuguguacggccgcauuuacauucaccaaagugcccgccgaaacucuccacggaaccguaacagucgaggugcaguacgcuggcaccgacgguccuugcaagauuccaguucaaauggccguggacaugcagacucugacacccgucgggagauuaauaacggcaaauccugugaucaccgaaaguacugagaacuccaagaugaugcuggaacuagauccacccuuuggcgacagcuacauuguaaucggagugggcgauaaaaagauaacacaucacuggcacaggucugggucaaccauuggaaaagcguucgaggcuacaguucggggugccaagcgcauggcaguccucggcgacacugccugggauuucgggagugugggaggcguguuuaacagccuggguaaagggauccaucagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6228 - RNA, 2449 nt, Artificial Sequence
  LC002520.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaccgucaacgacaucgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6229 - RNA, 2431 nt, Artificial Sequence
  DQ859059.1 prME-short mRNA Design 2 opt
ggggcgcugccuacggagguggcagccaucuccuucucggcaucaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacgagaaucgugccaagguagaaguuacaccuaacucaccacgcgcggaggccacucuugguggcuucgggagucugggauuggauugugagcccagaaccggccucgacuuuagcgaucuguacuauuuaacaaugaauaacaaacacuggcuggugcauaaggaaugguuccacgacaucccucucccauggcacgcaggggcugauacugggaccccgcauuggaauaacaaagaggcccuugucgaauuuaaggacgcucacgccaaaaggcagacaguggucgugcugggcucccaggagggagcaguucauaccgccuuggcuggcgcgcuagaagcagagauggauggggccaagggacggcuguucucuggucaccucaagugccgacugaaaauggacaaacuucgccugaagggcgugagcuacucauuguguacugcugccuuuacguucacaaagguacccgcagagacccuccaugggacugucaccguggaaguucaguaugccggaacagauggcccuugcaaagugccagcucaaauggccgucgacaugcagacccugacucccguggguagauuaaucacagcaaauccuguaauuacggagaguaccgaaaacuccaagaugaugcuggagcuagacccacccuuuggggauagcuacauagugaucggcguuggagacaagaaaauuacucaccacuggcauaggucuggcucaacaaucgggaaggcguucgaagcuaccguccggggagccaaacgcauggcagugcucggugauacagccugggacuucggcaguguggguggagucuuuaacagccugggcaaggguauacaccagauuuucggggcugccuuuaaaucccuuuucggcggaaugucuugguuuucgcaaaucuugaucggcacucugcucguuuggcuggggcuuaauaccaagaacggaagcauuucccugacguguuuggcacucggcggugugaugaucuuccugucaaccgcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6230 - RNA, 2437 nt, Artificial Sequence
  KU963573.2 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgagaaucucgaauaucggauuaugcugucggugcacgggucucaacauuccggaaugaucgguuacgagaccgacgaaaaccgugcgaaggucgaggugacaccuaauucaccacgcgccgaggcaacucuuggcggguucggaagucugggcuuggauugugaacccagaaccggucucgacuuuagcgaucuguauuacuuaacaaugaacaauaaacacuggcugguacauaaggagugguuccacgacaucccucucccauggcacgcuggggccgauacuggcaccccgcauuggaacaauaaagaagcucuuguugaguuuaaggacgcccacgcaaaaaggcagacaguggucgugcugggaucccaggaaggcgccguccauaccgcuuuggcgggggcacuagaggccgagauggauggagcuaaggguaagcuguucucuggccaccucaaaugccggcugaagauggacaaacuucgacugaagggggugagcuauucauuguguacugccgcauuuacguucacaaaaguucccgccgaaacccuccauggaacugugaccguagagguccaguacgcuggcacagaugguccuugcaagauuccagugcaaauggccguugacaugcagacccugacucccguggggcgcuuaauaacagcaaacccugucaucacggaaaguaccgaaaauuccaagaugaugcuggaacuagacccacccuuuggcgauagcuacauugugaucggaguaggcgacaaaaagauaacucaccacuggcauagaucugggucaacaauuggaaaagcguucgaggcuaccgugaggggugccaagcggauggcaguucucggcgauacagccugggacuucgggagugucggaggcguguuuaacagccuggguaaagggauccaccagaucuucggcgcugccuuuaagucccuuuucggaggcaugucuugguuuucgcaaauuuugaucgggacucugcucguguggcugggacuuaacaccaagaauggcagcauuucccugacguguuuggcacucgguggggucaugauauuccugucaaccgcuguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6231 - RNA, 2449 nt, Artificial Sequence
  KX694534.2 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguagggggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6232 - RNA, 2449 nt, Artificial Sequence
  KX369547.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccgggcuggcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggagucggcgagaaaaagaucacucaccacuggcaucggucugggucaacaauaggaaaggcauucgaagccaccgugcgcggugcuaaaagaauggccguacugggcgauacagcaugggacuuugggagugugggaggcgcucuuaauagcuuggguaaggggauucaccagaucuucggcgccgcguucaaaucccuguuuggaggcaugucuugguucucgcaaauccucauugggacucugcuuauguggcugggauugaacaccaagaauggcagcaucucccucaugugucuggccuuaggugggguucugauuuuucuaucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6233 - RNA, 2449 nt, Artificial Sequence
  KX447515.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacugguaucggucugggucaacaauaggaaaggcauuugaagccaccgugcgcggugcuaaaagaauggccguacucggcgauacagcaugggacuucgggagugugggaggcgcucugaauagccuugguaaggggauucaucagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6234 - RNA, 2449 nt, Artificial Sequence
  KU729218.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacacccagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6235 - RNA, 2449 nt, Artificial Sequence
  KU501217.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagauccgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6236 - RNA, 2449 nt, Artificial Sequence
  KU312314.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacuggcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6237 - RNA, 2449 nt, Artificial Sequence
  KX446950.2 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuacccuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6238 - RNA, 2449 nt, Artificial Sequence
  KY003157.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggucgugagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6239 - RNA, 2449 nt, Artificial Sequence
  KX811222.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaagugcauggguggucuauggcaccugucaucacaaaaagggugaagcccgccgaagccguagagcugugacucuaccgucccauucuacaaggaaacuccaaacccggccccagacguggcuggagucgcgcgaguacacuaagcaccuuauuagaguugaaaauuggaucuuuaggaacccuggguucgcacuggccgcugccgcgauugcaugguugcucggaucaagcaccagucagaaagugaucuaucuggucaugauacugcucaucgccccagcuuacuccauucggugcaucggcgugucuaaucgcgacuuuguagagggcaugagcgggggaacauggguugauguggucuuagaacaugguggcugugugacugugauggcccaggacaagcccaccgucgauauugagcugguuacaaccacgguguccaacauggcagagguacgaucauacugcuaugaagcuaguaucagcgacauggccucugauuccagauguccuacucaaggggaggcguaccuugacaagcagucagacacacaguaugugugcaaaaggaccuuggucgaucggggauggggcaaugguugugggcuguucggaaagggcagccuagugacuugcgccaaauuugcaugcaguaagaaaaugacaggcaagucuauacagccagaaaaccucgaguaccguauuaugcuguccguucacgggagccaacacucgggaaugaucgugaaugacaccggucaugaaacggaugagaaccgcgcuaaggucgagauuacccccaauucuccuagagccgaagcuacacuuggcggguucggaucccugggcuuggacugugagccaaggacuggucucgauuuuucagaccuguauuacuuaaccaugaacaauaaacacuggcuggugcauaaggaaugguuccacgauaucccgcuccccuggcacgccggggcagacacaggcacuccucauuggaacaauaaagaggcccuuguagaauuuaaggaugcucacgcgaaacggcagaccguugugguccugggaagucaggagggcgcagugcauacagccuuggcuggggcccuagaggcagaaauggacggagccaagggucgacugagcuccggccaccucaaaugccgccugaagauggauaaacuuagacugaaaggggucucuuauagcuuguguaccgcugccuucacuuuuacgaagaucccagcagagacacuccauggaaccgugacuguugaagugcaguacgcgggcaccgacggucccugcaaaguaccugcucaaauggccgucgacaugcagacacugaccccaguggggagguuaauuacugcaaaccccguuauaacagagucaacggaaaacaguaagaugaugcuggagcuagauccgccuuucggcgacuccuacaucgugauuggagucggcgagaaaaagaucacccaccacuggcaucggagcgggucuacuauaggaaaggccuuugaagcuacagugcgcggugccaaaagaauggcaguacucggcgauaccgcuugggacuucgggucagugggaggcgcccugaauagucuugguaaggggauucaccagaucuucggcgcggccuuuaagagcuuguucggaggcauguccugguuuucucaaauccugauugggacacuccugauguggcuuggacugaacacuaagaauggcucgaucagcuugaugugucucgcucugggugggguuuuaauuuuccuguccaccgcagucucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6240 - RNA, 2449 nt, Artificial Sequence
  KX447516.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacauccaaaaaggugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacagggggaggccuaccuugacaaacaaagcgacacccaguaugugugcaagaggacuuuggucgaucggggauggggcaaugguugugggcuguucggaaaaggcagucuagugacaugcgcgaaguuugccugcucuaaaaagaugaccggcaaguccauacagccugaaaaccucgaguaccguauuaugcugagcguucacgggucgcagcacucuggaaugaucgugaaugacacgggucaugaaaccgaugagaaccgcgcaaaagucgagauuacaccaaauucccccagagcugaagccacucuuggcggguucggaucacugggcuuggacugugagccuaggaccggucucgauuuuagugaccuguauuacuuaacaaugaacaauaagcacuggcuggugcauaaagaaugguuccacgauaucccacucccguggcacgcuggggccgacacuggcaccccucauuggaacaauaaggaggcacuuguagaauuuaaagaugcccacgcuaagcggcaaacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcagauggcugucgacaugcaaacccugacuccuguggggagguuaauuacagccaacccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaauagccuugguaaagggauucaccagaucuucggcgccgcguuuaaguccuuguucggaggcaugucuugguuuucgcagauccugauugggacucuccugauguggcuuggacugaacaccaaaaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6241 - RNA, 2449 nt, Artificial Sequence
  KX520666.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacacggcagaaagugaucuaucuggucaugauacugcucaucgcacccgccuacuccauucgcugcaucggcgugucuaaucgagacuuuguagagggcaugagcgggggaacuuggguugauguggucuuagaacaugguggcugugugaccgugauggcucaggacaagccaacagucgauauugagcugguuaccacgacuguguccaacauggccgagguaagaucauacugcuaugaagcaaguaucagcgacauggcuucugauuccaggugucccacacaaggggaggccuaccuugacaagcagucagacacccaguaugugugcaaacggacuuuggucgaucguggauggggcaaugguugugggcuguucggaaagggcagccuagugacaugcgcgaaauuugccugcaguaagaaaaugaccggcaagucuauacagccugaaaaccucgaguaccgcauuaugcuguccguucacgggagccaacacucgggaaugaucgugaaugacacgggucaugaaaccgaugagaacagagcaaaggucgagauuacaccaaauucucccagggcugaagccacucuuggcggguucggaucccugggcuuggacugugagccucggaccggucucgauuuuucagaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacgacagacaguugugguccugggaagucaggagggcgcggugcauaccgcauuggccggggcucuagaggccgaaauggacggagcaaagggucgccugagcuccggccaccucaaaugcagacugaagauggauaaacuuaggcugaaaggggucucuuauagcuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggcgguuaauuacagccaacccaguuauaacggagucaaccgaaaacaguaagaugaugcuggagcuagaucccccguucggcgacuccuacaucgugauuggagucggcgagaaaaagaucacucaccacuggcaucgcagcgggucuacaauaggaaaggcauuugaagccaccgugagaggugcuaaaaggauggccguacucggcgauacagcaugggacuucgggucagugggaggcgcucugaauagucuugguaaggggauucaccagaucuucggcgccgcguuuaagagcuuguucggaggcauguccugguuuucucaaauccugauugggacucuccugauguggcuuggacugaacaccaagaauggcucgaucagcuugaugugucucgcccugggugggguuuuaauuuuccuguccacggcugucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6242 - RNA, 2449 nt, Artificial Sequence
  KU497555.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaacccaggagggcgcggugcauacugcauuggccggggcucuagaggccgaaauggacggagcaaagggucgacugagcuccggccaccucaaaugccgccugaagauggauaaacuuagacugaaaggggucucuuauagcuuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagucaacugaaaacaguaagaugaugcuggagcuagaucccccguucggcgacuccuacaucgugauuggagucggcgagaaaaagaucacacaccacuggcaucggagcgggucuaccauaggaaaggcauuugaagccacagugcgcggugcuaaaagaauggccguacucggcgauacugcaugggacuucgggucagugggaggcgcucugaauagucuugguaaggggauucaccagaucuucggcgccgcguuuaagagcuuguucggaggcauguccugguuuucucaaauccugauugggacccuccugauguggcuuggacugaacacgaagaauggcucgaucagcuugaugugucucgcccugggugggguuuuaauuuuccuguccaccgcugucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6243 - RNA, 2449 nt, Artificial Sequence
  KY075939.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuuuacggugcauuggcgugagcaaucgcgacuuuguagagggcauguccgggggaacuuggguugaugugguccuggaacaugguggcugugugaccgugauggcucaggacaagccaacagucgauaucgagcuuguuaccacgacugugucaaacauggccgagguacgaaguuacugcuaugaagcaagcauuucugacauggcuuccgauucaagaugucccacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauccagccugaaaaccuggaguaccguauaaugcuuagcguucacgggucgcaacacucuggaaugauugugaaugacacgggucaugaaaccgaugagaaccgcgcaaaggucgagaucacaccaaauucccccagagcugaagccacucugggcggguucggaucauugggccucgacugugagccuaggaccggucuggauuuuagugacuuauauuaccugacaaugaacaauaaacacuggcucgugcauaaggaaugguuccacgauauuccacuuccguggcacgcuggggccgacacuggcaccccucauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagaucccugccgagacccugcauggaacugugaccguugaagugcaguacgcaggcacagacgguccaugcaaaguacccgcgcaaauggcugucgacaugcagaccuuaacuccuguggggaggcugaucacagccaacccaguuauuacggagaguaccgaaaacuccaagaugaugcuagagcucgaucccccguucggcgacagcuacauagugaucggagucggcgagaaaaagauuacucaccacuggcaucggucugggucaacaaucggaaaggcauuugaagccaccgugcgcggugcuaaaagaauggccguacugggcgauacagcaugggacuucgggagugugggaggcgcucuuaauagcuuggguaaggggauacaccagauuuucggcgccgcguuuaaaucccuguucggaggcaugucuugguuuucgcaaauccucaucgggacucugcuuauguggcugggauugaacaccaagaauggcagcauuucccucaugugucuggccuuaggugggguucugaucuuccuaucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6244 - RNA, 2449 nt, Artificial Sequence
  KY075932.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaaucgaaaauuggauuuuuaggaaccccggguucgcucuggcagccgcugccaucgcgugguugcucggaagcaguacaucccagaaaguuauauaucuggugaugauccugcucauugcacccgccuacucuauccggugcauuggcgucagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6245 - RNA, 2449 nt, Artificial Sequence
  KU870645.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauccugaggaaccccggguuugcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggaaucggcgagaaaaagauaacucaccacuggcaucggucugggucaacaauuggaaaggcauucgaagccaccguccgcggugcuaaaagaauggccgugcugggcgauacagcaugggacuuugggaguguaggaggcgcucuuaauagcuuggguaaggggauccaccagaucuucggcgccgcguucaaaucccuguuuggaggcaugucuugguucucgcaaauucucaucgggacucugcuuauguggcugggauugaacaccaagaauggcagcauuucccucaugugucuggccuuagguggggugcugauauuucuaucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6246 - RNA, 2449 nt, Artificial Sequence
  KU729217.2 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuucaaccacggugaguaacauggccgagguacgaagcuacugcuaugaagcaacuaucucugacauagcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacagcgguugugcugggaagccaggagggcgcaguccauaccgccuuggcuggggcccuagaggcagaaauggacggagccaagggucgacuguccucuggccaccucaaaugccgccugaagauggauaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagacaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6247 - RNA, 2449 nt, Artificial Sequence
  KX087101.3 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaacugcaguacgcaggcacagacgguccaugcaaagugcccgcgcaaauggcuguagacaugcagaccuuaacuccugucgggaggcugauuacagccaacccagugauaacggagaguaccgaaaacuccaagaugaugcuagagcucgaucccccguucggcgacagcuacaucguuauuggagugggcgagaaaaagaucacucaccacuggcaucggucugggucaacaauaggaaaggcauuugaagccaccguccgcggugcuaaaagaauggccgugcugggcgauacagcaugggacuucgggaguguaggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuagguggggugcugauuuuccuaucaacggcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6248 - RNA, 2449 nt, Artificial Sequence
  KY014317.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaucgaaaacuccaagaugaugcuggagcuagaucccccguucggcgacagcuacauugugaucggagucggcgagaaaaagauaacccaccacuggcaucggucugggucaacuauuggaaaggcauuugaagccacagugcgcggugcuaaaagaauggccguacucggcgauaccgcaugggacuucgggagugugggaggcgcucugaauagccuugguaaggggauccaccagaucuucggcgccgcguuuaaauccuuguucggaggcaugucuugguuuucgcaaauucugaucgggacacuccugauguggcuuggacugaacacuaagaauggcagcauuuccuugaugugucucgcccugggugggguuuuaauauuccugucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6249 - RNA, 2449 nt, Artificial Sequence
  KU758876.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagucaagggucgacuguccucuggccaccucaaaugccgccugaagauggauaaguuaagacugaaaggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuucauguguuuggcgcucggugggguccugauuuuucuuucaacggccgugagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6250 - RNA, 2449 nt, Artificial Sequence
  KU758874.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaaggguaaacuguccucuggccaccucaagugccgacugaagauggauaaacuucgccugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagauuaauuacagccaacccaguuauaacggagaguaccgaaaacuccaaaaugaugcuggagcuagaucccccguucggcgacagcuacaucgugauuggagucggcgagaagaagaucacucaccacuggcauaggucugggucaacaauaggaaaagcauuugaagccaccgugcggggugcuaagcgcauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6251 - RNA, 2449 nt, Artificial Sequence
  KY317939.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaaggaugcgggugaagcuauuucuuuccccaccacauugggcaugaacaaaugcuauauacagaucauggacuuagggcacaugugugaugccacuaugucauacgagugcccuaugcuggacgaaggaguggagccagaugacguagauuguuggugcaauaccacaaguaccuggguggucuauggcacuugucaucacaagaaaggugaagcacgccgaagccguagagccgugacacuaccgucccauucuaccaggaagcuccaaacgcggucgcagacuuggcuggagucacgcgaguacaccaaacaccuuauuagaguugaaaacuggaucuuuaggaaucccggguucgcucuggcagccgcugccauugcgugguugcucggaagcaguacaucccagaaggugaucuaucuggucaugauacugcucaucgcacccgccuacucuauucggugcaucggcgugagcaaccgcgacuuuguagagggcauguccgggggaacuuggguugauguggucuuagaacaugguggcugugugaccgugauggcucaggacaagccaacagucgauauugagcugguuaccacgacugugucaaauauggccgagguacgaaguuacugcuaugaagcaagcaucucugacauggcuuccgauucaagaugucccacacaaggggaggccuaccuugacaaacagagcgacacccaguaugugugcaagaggacuuuggucgaucggggauggggcaacgguugugggcuguucggaaaaggcagucuagugacaugcgcgaaguuugccugcucuaaaaagaugaccggcaaguccauacagccugaaaaucucgaguaccguauuaugcugagcguucacgggucgcaacacucuggaaugaucgugaacgacacgggucaugaaaccgaugagaaucgcgcaaaagucgagauuacaccaaacucccccagagcugaagccacucuuggcggguucggaucacugggcuuggacugugagccuaggaccggucucgauuuuagugaccuguauuacuuaacaaugaauaacaagcacuggcuggugcauaaagaaugguuccacgauaucccacucccguggcacgcuggggccgacacuggcaccccucauuggaauaacaaggaggcacuuguagaauuuaaagaugcccacgcuaagcggcagacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagguuaauuacagccaauccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaacagccuugguaaagggauucaccagaucuucggcgccgcguuuaaguccuuguucggaggcaugucuugguuuucgcaaauccugauugggacucuccugauguggcuuggacugaauaccaaaaacggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6252 - RNA, 2449 nt, Artificial Sequence
  KY014314.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaggcccacgcuaaacggcagacaguugugguccugggaagccaggagggcgcggugcauaccgcauuggccggggcucuagaagccgagauggauggagcaaagggucgacuguccucuggccaccucaaaugccgccugaagauggacaaacuuagacugaaaggggucagcuauucauuguguacugccgcuuucacguuuacaaagaucccugccgaaacccuccauggaacugugaccguugaggugcaguacgcaggcacagaugguccaugcaaaguacccgcgcaaauggcugucgacaugcagacccugacuccuguggggagguuaauuacagccaacccaguuauaacggaaaguaccgagaacuccaagaugaugcuggagcuagaucccccguucggcgacagcuacaucgugauuggagucggcgaaaagaagaucacucaccacuggcaucggucugggucaacaauaggaaaggcauuugaggccaccgugcgcggugcuaaaagaauggccguacucggcgacacagcaugggauuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6253 - RNA, 2449 nt, Artificial Sequence
  KX447517.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgccccugcauacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccgcucuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaacacugaucgggacucuccugauguggcuuggacugaacaccaagaauggcagcauuuccuugaugugucucgcucugggugggguuuuaaucuuccugucaacggcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6254 - RNA, 2449 nt, Artificial Sequence
  KU926310.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcgcggacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6255 - RNA, 2449 nt, Artificial Sequence
  KU922923.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcauuagccuacucuauucggugcaucggcgugagcaaucgcgacuuuguagagggcauguccgggggaacuuggguugaugugguccuggaacaugguggcugugugaccgugauggcucaggacaagccuacagucgauauugagcuuguuaccacgacugugucaaacauggccgagguacgaaguuacugcuaugaagcaagcaucucugacauggcuuccgauucaagauguccaacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauacagcccgaaaaccuggaguaccguauuaugcuuagcguucacgggucgcaacacucuggaaugaucgugaaugacacgggucaugaaaccgaugagaaccgcgcaaaggucgagauuacaccuaauuccccaagagcugaagccacucugggcggguucggaucauugggccucgacugugagcccaggaccggucuggauuuuagugacuuauauuaccugacaaugaacaauaaacacuggcucgugcauaaggaaugguuccacgauaucccucuuccauggcacgcuggggccgacacuggcaccccgcauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagauccccgccgagacccugcauggaacugugaccguugaagugcaguacgcaggcacagacgguccuugcaaaguaccagcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6256 - RNA, 2449 nt, Artificial Sequence
  KY075937.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacaugguguccgauucaagaugucccacacaaggggaggcuuaccuugacaagcagagcgacacccaguaugucugcaaaaggacuuugguggaucggggauggggcaaugguugugggcuguucggaaagggcagucuaguuacaugcgccaaauuugcgugcucuaagaaaaugaccggcaaguccauacagccugaaaaccucgaguaccguauuaugcugagcgugcacgggucgcaacacucuggaaugaucgucaaugacacgggucaugaaaccgaugagaaccgcgccaagguggagauuacaccaaauucccccagagcagaagcuacucuuggcggguucggaucacugggcuuggacugugagccuaggaccggucucgauuuuagugaccuguauuacuuaacaaugaacaauaaacacuggcugguacauaaggaaugguuccacgauaucccacucccguggcacgccggggcugacacuggcaccccucauuggaacaauaaagaggcccuuguugaauuuaaggaugcacacgccaaacggcagacaguggucgugcugggaagccaggagggcgcuguccauaccgcguuggcaggggcccuagaggcugaaauggacggagccaagggucgacuguccucuggccaccucaaaugccgccugaagauggauaaacuuagacugaagggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuugaugugucucgcgcuggguggggucuuaauuuuccugucaacggccgugagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6257 - RNA, 2449 nt, Artificial Sequence
  KY003156.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcauuagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaauccugggcuuggacugugagccuaggaccggucucgauuuuucagaccuguauuacuuaacaaugaacaauaaacacuggcugguccauaaggaaugguuccacgauauuccacucccguggcacgcuggggccgacacuggcaccccucauuggaacaauaaagaggcacuuguggaauuuaaggaugcccacgcuaaacggcagacaguaguugugcugggaagucaggagggcgcgguccauaccgcauuggccggggcucuagaggccgaaauggacggagcaaagggucgacugagcuccggccaccucaaaugccgccugaagauggauaaacuuagacugaaaggggugucuuauagcuuguguacugccgcuuucacguuuacaaagauaccugccgagacccuccauggaacugucaccguggaaguucaguacgcaggcacagacgguccaugcaaagugcccgcgcaaauggcuguagacaugcagacccugacuccugucgggagguuaaucacagccaacccagugauuacggagucaaccgaaaacaguaagaugaugcuggagcuagaucccccguucggcgacuccuacaucguuauaggagugggcgagaaaaagauuacucaccacuggcaucggagcgggucuacaaucggaaaggcauuugaagccaccguccgcggugcuaaaagaauggccgugcucggcgauacagcaugggacuucgggucaguaggaggcgcucugaauagucuugguaaggggauccaccagauuuucggcgccgcguuuaagagcuuguucggaggcauguccugguuuucucaaauccugauugggacucuccugauguggcuuggacugaacaccaagaauggcucgaucagcuugaugugucucgcccugggugggguguuaauauuccuguccacggcuguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6258 - RNA, 2449 nt, Artificial Sequence
  KU312313.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuauuaggaaacuccaaacgcggucgcagacuuggcuggagucacgcgaguacaccaagcaccuuaucagaguugaaaauuggauuuuuaggaaccccggguucgcucuggcagccgcugccaucgcgugguugcucggaagcaguacaucccagaaagugauauaucuggucaugauccugcucauugcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauaucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagauuccugccgagacccuccauggaacugugaccguugaagugcaguacgcaggcacagacgguccaugcaaaguacccgcgcaaauggcugucgacaugcagacccugacuccuguggggagguuaauaacagccaacccaguuaucacggagaguaccgaaaacuccaagaugaugcuggagcuagaucccccguucggcgacagcuacauugugaucggagucggcgagaaaaagauaacucaccacuggcaucggucugggucaacaauuggaaaggcauuugaagccaccgugcgcggugcuaaaagaauggccguacucggcgauacagcaugggacuucgggagugugggaggcgcucugaauagccuugguaaggggauccaccagaucuucggcgccgcguuuaaauccuuguucggaggcaugucuugguuuucgcaaauucugaucgggacucuccugauguggcuuggacugaacgccaagaauggcagcauuuccuugaugugucucgcucugggugggguuuuaauauuccugucaaccgcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6259 - RNA, 2449 nt, Artificial Sequence
  KY075935.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacaacgcagccgacgugccgugacacuaccgucccauucuaccagaaaacuccagacgaggucgcagacuuggcuggagucacgggaguacaccaagcaccuuauucgcguugaaaauuggaucuuuagaaaccccggguucgcucuggcagccgcugccauugcgugguugcucggaagcaguacaucccagaaagugaucuaucuggucaugauacugcucaucgcacccgccuacucuauuaggugcaucggcgugagcaaucgggacuuuguagagggcauguccgggggaacuuggguugauguggucuuagaacaugguggcugugugaccgugauggcucaagacaagccaacagucgauauugagcugguuaccacgacugugucaaacauggccgagguacgcaguuacugcuaugaagcaagcaucucugacauggcuuccgauucacgaugucccacacagggggaggccuaccuugacaagcagagcgacacccaguaugugugcaaaagaacuuuggucgauaggggauggggcaaugguugugggcuguucggaaagggcagucuagugacaugcgcgaaauuugccugcucuaagaaaaugaccggcaaguccauacaaccugaaaaccucgaguaccggauuaugcugagcguucacgggucgcagcacucuggaaugaucgugaaugacacgggucaugaaaccgaugagaaccgugcaaaggucgagauuacaccaaauuccccucgcgcugaagccacucuuggcggguucggaucacugggcuuggacugugagccuagaaccggucucgauuuuagugaccuguauuacuuaacaaugaacaauaaacacuggcuggugcauaaggaaugguuccacgauaucccacucccguggcacgcuggggccgacacuggcacaccccauuggaacaauaaagaggcacuuguagaauuuaaggaugcccacgcuaaaaggcagaccguugugguccugggaagccaggagggcgcggugcauaccgcauuggccggggcucuagaggccgaaauggacggagcaaagggucggcuguccucuggccaccucaaaugccgacugaagauggauaaacuucgccugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagauuaauuacagccaacccaguuauaacggagaguaccgaaaacuccaagaugaugcuggagcuagaucccccguucggcgacagcuacaucgugauuggagucggcgagaaaaagaucacucaccacuggcauaggucugggucaacaauaggaaaggcauuugaagccaccgugcggggugcuaaacgcauggccguacucggcgauacagcaugggacuucgggagugugggaggcgcucugaauagccuugguaaggggauucaccaaaucuucggcgccgcguuuaaauccuuguucggaggcaugucuugguuuucgcagauccugauugggacucuccugauguggcuuggacugaacaccaagaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6260 - RNA, 2449 nt, Artificial Sequence
  KY014320.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaagcucggucgcagacguggcuggagucacgcgaguacacuaagcaccuuauuagaguugaaaauuggaucuuuaggaaccccggguucgcacuggccgcugccgcgauugcaugguugcucggaagcaguaccucccagaaagugaucuaucuggucaugauacugcucaucgccccugcuuacucuauucggugcaucggcgugagcaaucgcgacuuuguagagggcauguccgggggaacauggguugauguggucuuagaacaugguggcugugugacugugauggcccaggacaagccaaccgucgauauugagcugguuacaaccacggugucaaacauggcagagguacgaaguuacugcuaugaagcuagcaucucugacauggccuccgauucaagaugucccacucaaggggaggcguaccuugacaagcagagcgacacacaguaugugugcaaaaggaccuuggucgaucggggauggggcaaugguugugggcuguucggaaagggcagucuagugacuugcgccaaauuugcaugcucuaagaaaaugacaggcaaguccauacagccugaaaaccucgaguaccguauuaugcugagcguucacgggucgcaacacucuggaaugaucgugaaugacaccggucaugaaacggaugagaaccgcgcuaaggucgagauuaccccaaauucccccagagccgaagcuacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6261 - RNA, 2449 nt, Artificial Sequence
  KY328290.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaaaggggucucauauaguuuguguacugccgcuuucacguuuuccaagaucccugccgagacacuccauggaaccgugacugaagagguucaguacgcaggcaccgacgguccaugcaaagugcccgcgcaaauggcuguagacaugcagacacugaccccugucgggagguuaauuacugccaauccagugauaacagaaagcacggagaacucuaagaugaugcuggagcuagaucccccguucggcgacucauacaucguuauuggagugggcgaaaagaagaucacccaccacuggcaucggagugggagcacuauaggaaaggcauuugaggccacaguccgcggugcuaaaagaauggccgugcucggcgauaccgcaugggacuucggguccguaggaggcgcucugaacucucuugguaaggggauucaccagaucuucggcgccgcguuuaaaucguuguucggaggcaugagcugguuuucccaaauccugauugggacacuccugauguggcuuggacugaauacuaagaacggcucaaucaguuugaugugucucgcccugggugggguguuaauuuuccugucuaccgcuguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6262 - RNA, 2449 nt, Artificial Sequence
  KU681081.3 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgccccugcauacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacacuggggcugacaccggcacaccccauuggaauaacaaagaggcccuuguagaauuuaaggaugcacacgccaaacggcagaccguugugguccugggaucccaggagggcgcugugcauacugcguuggcaggggcccuagaggcugaaauggacggagccaagggucgacugucuagcggccaccucaaaugccgccugaagauggauaagcugagacugaaaggggucucauauaguuuguguacggcagccuucacauuuaccaagaucccugcugagacucuccauggaaccgugacaguugaagugcaguacgccggcaccgacgguccaugcaaaguacccgcacaaauggcggucgacaugcagacucugacaccuguggggagguuaauuacggcuaauccaguuauaaccgagggcacugaaaacuccaagaugaugcuggagcuagaucccccguucggagacagcuacaucgugauuggcgucggggagaaaaagaucacacaccacuggcaucggucuggaucaaccauagguaaggccuuugaagcaacagugcgcggcgccaaaagaauggcuguacucggggauacugccugggacuucggaagugugggcgguguucugaacagccuugggaagggcauucaccagaucuucggagcagcuuuuaaauccuuguucggcgggaugucuugguuuucgcaaauccugauuggaacccuccugauguggcuuggccugaauacgaagaacgguagcaucuccuugaugugucucgcccuugggggagucuuaauuuuccugucaaccgcggugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6263 - RNA, 2449 nt, Artificial Sequence
  KX827309.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugaugugucucgcccugggugggguuuuaauuuuccugaguacggcugucucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6264 - RNA, 2449 nt, Artificial Sequence
  KU955593.1 prME-short mRNA Design 2 opt
ggggcgcugccuacggagguggcagccaucuccuucucggcaucaagcuuaccaugaccagcgugggcaucgucgggcugcuccuuacaacugccauggcuguugaggugacgagaaggggaaacgcauacuauauguaccuggaccgguccgaugccggugaagcgauuucuuuccccaccacaaugggcaugaauaagugcuauauacagaucauggacuuggggcacaugugugaugcuacuaugucauacgagugcccuauguuagacgaaggaguagagccagaugacguggauuguuggugcaacaccacaaguaccugggucguguauggcacuugucaucacaaaaagggugaagcccgccgaagccguagagcaguuacacugccgucccauucuaccaggaaacuacaaacgcggucgcagacuuggcucgagucacgcgaguacaccaagcaccugauuagaguggaaaauuggaucuuuaggaaccccggguucgcccuugcugcagccgcuauugccuggcuguugggaagcaguacaucccagaaagucaucuaucucgugaugauacugcugaucgcgccugcauacucuauucggugcaucggcguaagcaaucgcgacuuuguugagggcauguccgggggaacuuggguggaugucgugcucgaacaugguggcugugugaccgucauggcccaggacaagccaacaguugauauugaguuagugaccacgacuguaucaaacauggcugaggugcgaaguuacugcuaugaagccagcaucucugacauggcauccgauucaagaugucccacacaaggggaggcuuaccuggacaagcagagcgacacccaguaugucugcaaaaggacucuuguggaucggggauggggcaaugguuguggguuguucggaaagggcagucugguuacaugcgccaaauuugcgugcucuaagaaaaugaccggcaaguccauacagccugaaaaccuagaguaccguauuaugcucagcgugcacgggucgcaacacucuggaaugaucgucaaugacacgggucaugaaaccgaugagaaccgcgccaagguggagauuacaccaaauucccccagagcagaagcuacucugggcggguucggaucacuuggccuggacugugagccuaggaccgguuuggauuuuagugaccucuauuaccugacaaugaacaauaaacacugguuaguacauaaggaaugguuccacgauaucccacugccguggcacgccggggcugacacuggcacaccccauuggaacaauaaagaggcccucguugaauuuaaggaugcacacgccaaacggcagaccguggucgugcuuggaagccaggagggcgcuguccauaccgcgcuggcaggggccuuggaggcugaaauggacggagccaagggucgacuauccucuggccaccugaaaugccgccucaagauggauaagcugagacuuaaaggggugagcuauucacuguguacugcagccuucacguuuacaaagaucccugcugagaccuugcauggaacuguuaccguggaaguacaguacgccggcacagacgguccaugcaaaguccccgcacaaauggcgguggacaugcagacccucacuccuguugggaggcugauuacagcuaacccagugauaacggagaguaccgaaaacuccaagaugauguuagagcuggaucccccguucggcgacagcuacaucgucauuggagugggcgagaaaaagaucacucaccacuggcaucggucugggucaacaauaggaaaggccuuugaagcaaccguacgcggugccaaaagaauggcugugcuaggcgauacagccugggacuucgggaguguuggaggcgcacucaauagccuggguaaggggauucaccagaucuucggcgcugccuuuaaaucccuuuucggaggcaugucuugguuuucgcaaaucuugauugggacucugcucgucuggcugggacuuaacaccaagaauggcagcaucucccugauguguuuggcgcucgguggggugcugauuuucuuaucaacggccgugagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6265 - RNA, 2449 nt, Artificial Sequence
  KY272987.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugguuugucucgcccuggguggggucuuaauuuuccugaguacggcugugucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6266 - RNA, 2449 nt, Artificial Sequence
  KY007221.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcgugaacaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugguuugucucgcccuggguggggucuuaauuuuccugucaacggcugugagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6267 - RNA, 2449 nt, Artificial Sequence
  EU545988.1 prME-short mRNA Design 2 opt
ggggcgcugccuacggagguggcagccaucuccuucucggcaucaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgcuauugccugguugcucggaaguuccacaucucagaaagucaucuaucuggugaugauacugcucaucgcgccugcauacagcauucggugcaucggcguauccaaccgcgacuuuguugagggcaugucagggggaacuuggguggaugucguguuagaacaugguggcugugugaccgucauggcccaggacaagccagcuguugauauugagcuggugacaaccacgguaaguaauauggccgaggugcgaagcuacugcuaugaagcaucuaucuccgacauggcuucagauagcagaugucccacucaaggggaggccuaccuugacaagcagagugacacacaguaugucugcaaaaggaccuugguggaucggggauggggcaacgguugugggcuguucggaaagggcucucuaguuacuugcgcgaaauuugccugcuccaagaaaaugacaggcaagagcauacagccugaaaaucucgaguaccguauuaugcugucggugcacgggucucaacacuccggaaugaucgucaacgacaccggucaugaaacggaugagaaucgcgcaaagguggagauuaccccaaacucacccagagcugaagccacacuuggcggguucggaagucugggcuuggacugugagccuaggacuggucucgauuuuagcgaccuguauuacuuaaccaugaauaacaaacacuggcugguacauaaggaaugguuccacgauaucccacucccguggcacgcuggggccgacacaggcacuccccauuggaauaacaaagaggcacuuguugaauuuaaggaugcccacgcuaaacggcagaccguggucgugcugggaucccaggagggcgcgguccauacagcauuggccggggcucuagaggccgaaauggacggagcaaagggucgacugucuagcggccaccucaaaugccgccugaagauggauaaacuuagacugaagggggugucauauaguuuguguaccgccgcuuucacuuuuacgaagaucccugccgagacacuccauggaaccguuacuguggaaguacaguacgcaggcaccgacgguccaugcaaaguccccgcgcaaauggcuguggacaugcagacacugaccccuguugggagguuaauuacugccaauccagugauaacagaguccacggaaaacagcaagaugaugcuggagcuagaucccccguucggcgacucuuacaucgucauuggagugggcgagaaaaagaucacccaccacuggcaucggucagggaguacuauaggaaaggcauuugaagccacaguacgcggugcuaaaagaauggccgugcucggcgauaccgcaugggacuucgggagcguuggaggcgcucugaacucccuugguaaggggauucaccagaucuucggcgccgcguuuaaaucuuuguucggaggcaugucgugguuuagccaaauccugauugggacacuccuggucuggcuuggacugaauacuaagaacggcuccaucucauugaccugucucgcccugggugggguguuaauuuuccugaguacggcugugucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6268 - RNA, 2449 nt, Artificial Sequence
  KU681082.3 prME-short mRNA Design 2 opt
ggggcgcugccuacggagguggcagccaucuccuucucggcaucaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgucauugcuugguugcucggaaguuccacaucucagaaagugaucuaucugguaaugauacugcucaucgccccugcguacagcauucggugcaucggcguuuccaaccgcgacuuuguggagggcaugucagggggaacuugggucgaugugguguuagaacaugguggcugugucaccguuauggcacaggacaagccaacaguggauauugagcugguaaccacgacugugaguaauauggccgagguccgaagcuacugcuaugaggcuucuaucuccgacauggccucagauagcagaugucccacacaaggggaagcauaccuugacaagcagagugacacccaguaugugugcaaaaggacuuugguugaucggggauggggcaacgguugugggcuguucggaaagggcucucuagugacaugcgcuaaauuugccugcuccaagaaaaugaccggcaagagcauacagccugaaaaucucgaguaccguauuaugcugucgguccacgggucucaacacuccggaaugaucgugaacgacacgggucaugaaaccgaugagaaucgcgcgaagguagagauuacaccaaacucacccagagccgaagcaacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgcuggggccgacacuggcacaccccauuggaauaacaaagaggcucuuguggaauuuaaggaugcccacgcaaaacggcagaccgucgugguccugggaucccaggagggcgccgugcauaccgcuuuggcgggggcacuagaggccgaaauggacggagcuaagggucgacugucuagcggccaccucaaaugccgccugaagauggauaaacuuagacugaaggggguuucauauaguuuguguacugccgcauucacguuuacaaagaucccugccgagacccuccauggaacugugaccguagaaguccaguacgcuggcacagacgguccaugcaaagugcccgcccaaauggcaguugacaugcagacccugacuccuguggggagguuaauuacagcgaauccagucauaacggaguccaccgaaaacagcaagaugaugcuggagcuagaucccccguucggcgacucuuacaucgugauuggaguaggcgagaaaaagaucacucaccacuggcaucggucagggaguacaauaggaaaggcuuuugaagccaccgugcgcggugcaaaaagaauggccguucucggcgauacagcuugggacuucgggagcgucggaggcgcccugaacucccuugguaaggggauucaccagaucuucggcgcagcuuuuaaaucuuuguucggaggcaugucgugguuuagccaaauccugauugggacucuccugguguggcuuggacugaauaccaagaacggcuccaucucauugacgugucucgcccugggugggguguuaauuuuccugaguaccgcggucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6269 - RNA, 2449 nt, Artificial Sequence
  KX601167.1 prME-short mRNA Design 2 opt
ggggcgcugccuacggagguggcagccaucuccuucucggcaucaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcguaaacaagugcuauauacagaucauggacuuagggcacaugugugaugcuacuaugaguuacgagugcccuaugcuggacgaaggaguggagccagaugacgucgauuguuggugcaauaccacaagcaccugggugguuuauggcacuugucaucacaaaaagggugaagcccgccgaucccguagagcagugacacuaccgucucauucgaccaggaaacuccaaacgcggucacagacuuggcuggagagccgcgaguacaccaagcaccuuauuagagucgaaaacuggaucuuuaggaaucccggguucgcccuggcugcagccgcuauugccugguugcucggaaguuccacaucucagaaagugaucuaucugguaaugauacugcucaucgcgccugcauacagcauucggugcaucggcguuuccaaccgcgacuuuguggagggcaugucagggggaacuugggucgaugugguguuagaacaugguggcugugucaccguuauggcccaggacaagccaacaguggauauugagcugguaaccacgacugugaguaauauggcugagguccgaagcuacugcuaugaagccucuaucuccgacauggcaucagauagcagaugucccacacaaggggaggcuuaccuugacaagcagagugacacccaguaugugugcaaaaggacuuugguugaucggggauggggcaacgguugugggcuguucggaaagggcucucuagugacaugcgccaaauuugcgugcuccaagaaaaugaccggcaagagcauacagccugaaaaucucgaguaccguauuaugcugucgguccacgggucucaacacuccggaaugaucgugaacgacacgggucaugaaaccgaugagaaucgcgccaagguagagauuacaccaaacucacccagagcagaagcuacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgccggggcugacacuggcacaccccauuggaauaacaaagaggcccuuguggaauuuaaggaugcacacgccaaacggcagaccgucgugguccugggaucccaggagggcgcugugcauaccgcguuggcaggggcccuagaggcugaaauggacggagccaagggucgacugucuagcggccaccucaaaugccgccugaagauggauaaacuuagacugaaggggguuucauauaguuuguguacugcagccuucacguuuacaaagaucccugcugagacccuccauggaacugugaccguagaaguccaguacgccggcacagacgguccaugcaaagugcccgcacaaauggcgguugacaugcagacccugacuccuguggggagguuaauuacagcuaauccagucauaacggaguccaccgaaaacagcaagaugaugcuggagcuagaucccccguucggcgacucuuacaucgugauuggaguaggcgauaaaaagaucacucaccacugguaucggucagggaguacaauaggaaaggccuuugaggcaaccgugcgcggugccaaaagaauggcuguucucggcgacacagccugggauuucgggagcgucggaggcgcacugaacucccuugguaaggggauucaucagaucuucggcgcugccuuuaaaucuuuguucggaggcaugucgugguuuagccaaauccugauugggacucuccugguguggcuuggacugaauaccaagaacggcuccaucucauugacgugucucgcgcugggugggguguuaauuuuccugaguaccgccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6270 - RNA, 2449 nt, Artificial Sequence
  KX694533.2 prME-short mRNA Design 2 opt
ggggcgcugccuacggagguggcagccaucuccuucucggcaucaagcuuaccaugaccagcgugggcaucgucgggcugcuccuuacaacugccauggcuguugaggugacgagaaggggauccgcauacuauauguaccuggaccggucugaugccgguaaggcgauuucauuccccaccacauugggcguaaacaaaugcuauauacagaucauggacuuagggcacaugugugaugcuacuaugaguuacgaaugcccuaugcuggacgagggaguggaaccagaugacgucgauuguuggugcaauaccacaagcaccugggugguuuauggcacuugucaucacaagaaaggugaggcccgccgaucccguagagcagugacacuaccgucucauucgaccaggaagcuccaaacgcggucacagacuuggcuggaaagccgcgaguacaccaaacaccuuauuagagucgagaacuggaucuuuaggaaucccggguucgcccuggcugcagccgcuauugccugguugcucggaaguuccacaucucagaaggugaucuaucugguaaugauacugcucaucgcgccugcauacagcauucggugcaucggcguuuccaaccgcgacuuuguggaaggcaugucagggggaacuugggucgaugugguguuagagcaugguggcugugucaccguuauggcccaggacaagccaacaguggauauugaacugguaaccacgacugugaguaauauggcugagguccgaagcuacugcuaugaggccucuaucuccgacauggcaucagauagcagaugucccacacaaggggaggcuuaccuugacaaacagagugacacccaguaugugugcaagaggacuuugguugaucggggauggggcaacgguugugggcuguucggaaaaggcucucuagugacaugcgccaaguuugcgugcuccaaaaagaugaccggcaagagcauacagccugaaaaucucgaauaccguauuaugcugucgguccacgggucucaacacuccggaaugaucgugaacgacauuggucaugagacggaugaaaaucgcgccaaaguagagaucaccccaaacucacccagagcagaggcuacacuuggcggguucggaagucugggcuuggacugugaaccuaggacuggucucgauuuuagcgaccuguauuacuuaaccaugaauaacaagcacuggcugguucauaaagagugguuccacgauaucccacucccguggcacgccggggcugacacaggcacuccccauuggaauaacaaggaagcccuuguggaguuuaaagaugcacacgccaagcggcagaccgucgugguccugggaucccaggaaggcgcugugcauacagcguuggcaggggcccuagaggcugagauggacggagccaaaggucgacugucuagcggccaccucaagugccgccugaagauggauaaacuuagacugaaggggguuucauauaguuuguguaccgcagccuucacuuuuacgaaaauuccugcugaaacacuccauggaaccgugacuguagagguccaguacgccggcaccgacgguccaugcaaggugcccgcacaaauggcgguugacaugcagacacugaccccuguggggagguuaauaacugcuaauccagucaucacagaauccacggagaacagcaaaaugaugcuggaacuagaucccccguucggcgacucuuacauugugaucggaguaggcgauaagaagauaacccaccacuggcaucggucagggaguacuauuggaaaagccuuugaggcaacagugcgcggugccaagagaauggcuguucucggcgacaccgccugggauuucgggagcgucggaggcgcacugaacucccuugguaaagggauccaccagaucuucggcgcugccuuuaagucuuuguucggaggcaugucgugguuuagccaaauucugaucgggacacuccugguguggcuuggacugaauacuaaaaacggcuccauuucauugaccugucucgcgcugggugggguguuaauauuccugaguacggccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6271 - RNA, 2449 nt, Artificial Sequence
  KY288905.1 prME-short mRNA Design 2 opt
ggggcgcugccuacggagguggcagccaucuccuucucggcaucaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacacaggucacgagacugaugaaaaucgugccaagguagagguuaccccuaacucaccacgcgcggaggccacacuuggcggguucggaagucugggcuuggacugugaacccagaacuggucucgauuuuagcgaccuguacuauuuaaccaugaauaacaaacauuggcuggugcacaaggagugguuccacgauaucccucucccauggcaugcaggggcugacacaggcaccccgcacuggaauaacaaagaagcccuugucgaguuuaaggaugcucaugccaaaaggcagacuguggucgugcugggaucccaggaaggcgcaguucacacggccuuggcuggggcgcuagaggcagagauggacggagccaagggucggcuguucucuggccaucucaagugccgacugaaaauggauaaacuucgccugaagggggugagcuacucauuguguacagcugccuuuaccuucacuaagguacccgcagaaacccuccacggaacagucaccguggagguucaguaugccggcacugacgguccuugcaaagugccagcucaaauggccgucgacaugcagacacugacgcccguggggagauuaaucaccgcaaauccuguaauuacugaaaguacagagaacuccaagaugaugcuggaacuagauccacccuuuggcgacagcuacauagugaucggaguuggcgauaagaaaauuacccaccauuggcacaggucugggucaacaaucggaaaggcguucgaggcuacuguccggggugccaaacgcauggcagugcucggcgacaccgccugggauuucgggagugugggaggcgucuuuaacagccuggguaaggggauacaucagauuuucggcgcugccuuuaaaucccuuuucggaggcaugucuugguuuucgcaaaucuugaucgggacgcugcucguuuggcugggacuuaauaccaagaacggcagcauuucccugacauguuuggcacucgguggggugaugaucuuccugucaacugcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6272 - RNA, 2449 nt, Artificial Sequence
  KF268950.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacaucggucacgagacggaugaaaaccgugccaaggucgaggugaccccuaauucaccacgcgcagaggcuacacuuggcggguucggaagucugggcuuggacugugaacccagaacuggucucgauuuuagcgaccuguacuauuuaaccaugaacaauaaacauuggcugguacacaaggagugguuccacgauauuccucucccauggcaugccggggcugacacaggcacuccgcacuggaacaauaaagaagcccuuguugaguuuaaggaugcacaugccaaaaggcagaccguggucgugcugggaucccaggaaggcgcuguccacacagcguuggcaggggcccuagaggcugagauggacggagccaagggucggcuguucucuggccaucucaagugccgacugaaaauggauaaacuucgccugaagggggugagcuacucauuguguaccgcagccuuuacuuucacgaagguucccgcugaaacacuccacggaaccgugacuguagagguccaguaugccggcaccgacgguccuugcaaagugccagcacaaauggcgguugacaugcagacacugacccccguggggagauuaauaacugcuaacccugucaucacagaaaguacggagaacuccaagaugaugcuggaacuagauccacccuuuggcgacagcuacauugugaucggaguaggcgauaagaaaauaacccaccauuggcacaggucugggucaacuauuggaaaggccuucgaggcaacagugcggggugccaaacgcauggcuguucucggcgacaccgccugggauuucgggagugucggaggcguguuuaauagccuggguaagggggugcaucagaucuucggcgcagcuuuuaaaucccuuuucggaggcaugucuugguuuucgcaaaucuugauugggacacugcucgucuggcugggacuuaacacuaagaauggcagcaucucccugaccuguuuggcccucggugggguuaugauuuuccugucaacggcggugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6273 - RNA, 2449 nt, Artificial Sequence
  KF383121.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaucggucacgagaccgaugaaaaucgugcgaagguggagguaacaccuaacucaccacgcgccgaggcaacucuuggcggguucggaagucugggcuuggacugugaacccagaaccggucucgauuuuagcgaccuguacuauuuaacaaugaauaacaaacauuggcugguucacaaggagugguuccacgauauuccucucccauggcaugcuggggccgacacuggcaccccgcacuggaauaacaaagaagcucuuguggaguuuaaggaugcccaugcaaaaaggcagacagucgugguccugggaucccaggaaggcgccgugcacaccgcuuuggcgggggcacuagaggccgagauggacggagcuaagggucggcuguucucuggccaucucaagugccgacugaaaauggauaaacuucgccugaaggggguuagcuacucauuguguacugccgcauuuacguucacaaaggugcccgccgaaacccuccacggaacuguaaccgucgaggugcaguaugcuggcacagacgguccuugcaaaguuccagcccaaauggcaguggacaugcagacccugacucccgucgggagauuaauaacagcgaauccugugaucacggaaaguaccgagaacuccaagaugaugcuggaacuagauccacccuuuggcgacagcuacauuguaaucggagugggcgauaagaaaauaacucaccauuggcacaggucugggucaacaauuggaaaggcuuucgaggccaccguucggggugcaaaacgcauggccguccucggcgacacagcuugggauuucgggagugugggaggcguguuuaacagccuggguaaggggauccaucagaucuucggcgccgcauuuaaaucccuuuucggaggcaugucuugguuuucgcaaauuuugaucgggacucugcucgucuggcugggacuuaauaccaagaacggcagcauuucccugacguguuuggcucucggugggguuaugauauuccugucaaccgccgugagugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6274 - RNA, 2431 nt, Artificial Sequence
  KF268949.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacgagaaccgugccaaggucgaagugacgccuaauucaccacgcgcagaggcuacccuugguggcuucgggagucugggauuggauugugagcccagaacaggccucgacuuuagcgaucuguacuauuuaacuaugaacaauaaacacuggcugguacauaaggaaugguuccacgacaucccucucccauggcacgccggugcugauaccgggacaccgcauuggaacaauaaagaggcccuuguugaauuuaaggacgcacacgccaaaaggcagacuguggucgugcugggcucccaggagggagcuguccauaccgcguuggcaggcgcccuagaagcugagauggauggggccaagggacggcuguucucuggucaccucaagugccgacugaaaauggacaaacuucgccugaagggcgugagcuacucauuguguacagcagccuuuaccuucacuaagguucccgcugagacgcuccaugggacagugaccguagaaguccaguaugccggaacugauggcccuugcaaagugccagcacaaauggcgguugacaugcagacccugacacccguggguagauuaauuaccgcuaacccugucauaacugagaguacagaaaacuccaagaugaugcuggagcuagacccacccuuuggggauagcuacaucgugauuggcguaggagacaagaaaaucacgcaccacuggcauaggucuggcucaaccauagggaaggccuucgaagcaacugugcggggagccaaacgcauggcuguucucggugauacagccugggacuucggcagugucgggggaguguuuaauagccugggcaaggguauucaccagaucuucggggcagcuuuuaaaucccuuuucggcggaaugucuugguuuucgcaaaucuugauuggcacccugcucguguggcuggggcuuaacacaaagaauggaagcaucucccugacuuguuuggcccucggcggugucaugauuuuccugucaaccgcgguuagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6275 - RNA, 2449 nt, Artificial Sequence
  KU955595.1 prME-short mRNA Design 2 opt
ggggcgcugccuacggagguggcagccaucuccuucucggcaucaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacaccggucacgagacagaugaaaaucgugcgaagguagagguuacuccuaacucaccacgcgccgaggcaacccuuggcggguucggaagucugggcuuggacugugaacccagaacaggucucgauuuuagcgaccuguacuauuuaacuaugaauaacaaacauuggcuggugcacaaggagugguuccacgauaucccucucccauggcaugcuggggccgacaccggcacaccgcacuggaauaacaaagaagcucuugucgaguuuaaggaugcccaugcaaaaaggcagaccguggucgugcugggaucccaggaaggcgccguucacacugcuuuggcgggggcacuagaggccgagauggacggagcuaagggucggcuguucucuggccaucucaagugccgacugaaaauggauaaacuucgccugaagggggugagcuacucauuguguacggccgcauuuacauucaccaagguacccgccgaaacucuccacggaaccgucacaguggagguucaguaugcuggcaccgacgguccuugcaaagugccagcccaaauggcagucgacaugcagacucugacacccguggggagauuaaucacggcgaauccuguaauuaccgaaaguacugagaacuccaagaugaugcuggaacuagauccacccuuuggcgacagcuacauagugaucggaguuggcgauaagaaaauuacacaccauuggcacaggucugggucaaccaucggaaaggcuuucgaggccacaguccggggugcaaaacgcauggccgugcucggcgacacugcuugggauuucgggagugugggaggcgucuuuaacagccuggguaaggggauacaucagauuuucggcgccgcauuuaaaucccuuuucggaggcaugucuugguuuucgcaaaucuugaucgggacccugcucguuuggcugggacuuaauacgaagaacggcagcauuucccugaccuguuuggcucucgguggggugaugaucuuccugucaacagccgugagugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6276 - RNA, 2449 nt, Artificial Sequence
  KF383116.1 prME-short mRNA Design 2 opt
ggggcgcugccuacggagguggcagccaucuccuucucggcaucaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaacacaagaaaggugaggcccgccgaucccguagagcugugacacuaccaucucauucgaccaggaagcuccagacgcggucacagacuuggcuggaaagccgcgaguauaccaaacaccuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcaugguggcugugucaccguuauggcccaagacaaaccuacaguggauaucgaacugguaaccacgacugugaguaauauggcugagguccgcagcuacugcuacgaggccucuauauccgacauggcaucagauagccgauguccaacacagggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucaacccgaaaaucucgaauaucggaucaugcugucgguccacgggucucagcacuccggaaugauugugaacgacaucggucaugagaccgaugaaaaucgugcgaagguagagguuacaccuaacucaccacgcgccgaggcaacucuuggcggguucggaagucugggcuuggacugugaacccagaaccggucucgauuuuagcgaccuguacuauuuaacaaugaauaacaaacacuggcuggugcauaaggagugguuccacgauaucccucucccauggcacgcuggggccgacacuggcaccccgcauuggaauaacaaagaagcucuugucgaguuuaaggaugcccacgcaaaaaggcagacaguggucgugcugggaucccaggaaggcgccguucauaccgcuuuggcgggggcacuagaggccgagauggacggagcuaagggucggcuguucucuggccaccucaagugccgacugaaaauggauaaacuucgccugaagggggugagcuacucauuguguacugccguaugcacggcagccaagguccccgcugaaacacuccauggaaccgugacuguugaggugcaauaugccggcaccgacgguccuuguaaagucccagcacagauggcgguggacaugcagacacugacccccguagggagauuaauuacugcuaauccugugauaacagaaaguacggagaacuccaagaugaugcuggaacuagauccacccuuuggcgacagcuacaucguuauuggagucggcgauaagaaaaucacccaccacuggcauaggucugggucaacuauaggaaaggccuucgaggcaacagugcggggugccaaacgcauggcugugcucggcgacaccgccugggauuuugggagugucggaggcguuuucaacagccuggguaaggggauucaccaaaucuucggcgcagcuuuuaaaucccuuuucggaggcaugucuugguuuucgcagaucuugauugggacacugcucguguggcugggacuuaauacuaagaacggcagcaucucccugaccugcuuggcccucgguggggugaugauuuuccugucaacggcgguaagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6277 - RNA, 2431 nt, Artificial Sequence
  KX601166.1 prME-short mRNA Design 2 opt
ggggcgcugccuacggagguggcagccaucuccuucucggcaucaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacgagaaucgugcgaagguagaaguuaccccuaacucaccacgcgccgaggcaacacuugguggcuucgggagucugggauuggauugugagcccagaacuggccucgacuuuagcgaucuguacuauuuaaccaugaauaacaaacacuggcuggugcauaaggaaugguuccacgacaucccucucccauggcacgcuggugccgauacagggacuccgcauuggaauaacaaagaggcucuugucgaauuuaaggacgcccacgcaaaaaggcagaccguggucgugcugggcucccaggagggagccguucauacagcuuuggcgggcgcacuagaagccgagauggauggggcuaagggacggcuguucucuggucaccucaagugccgacugaaaauggacaaacuucgccugaagggcgugagcuacucauuguguaccgccgcauuuacuuucacgaagguacccgccgagacacuccaugggaccgucacuguggaaguucaguaugcuggaaccgauggcccuugcaaagugccagcccaaauggcagucgacaugcagacacugacccccguggguagauuaaucacugcgaauccuguaauuacagagaguacggaaaacuccaagaugaugcuggagcuagacccacccuuuggggauagcuacauagugaucggcguuggagacaagaaaauuacccaccacuggcauaggucuggcucaacuaucgggaaggcuuucgaagccacaguccggggagcaaaacgcauggccgugcucggugauaccgcuugggacuucggcagugucgggggaguguuuaacagccugggcaaggguauacaccagauuuucggggccgcauuuaaaucccuuuucggcggaaugucuugguuuucgcaaaucuugaucggcacacugcucguuuggcuggggcuuaauacuaagaacggaagcauuucccugaccuguuuggcucucggcggugugaugaucuuccugucaacggccgugagugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6278 - RNA, 2449 nt, Artificial Sequence
  KF383118.1 prME-short mRNA Design 2 opt
ggggcgcugccuacggagguggcagccaucuccuucucggcaucaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugagacacgccgaucccguagaucugucucgcuaagguaucacuacacccggaagcuccaaacgcgcucacagacuuggcuggaaagcagagaguauaaaaagcaucuuauuaugguggagaacuggaucuuuaggaauccaggguucgccauaguuaguguggcuaucaccuggcugaugggauccuugacaucucagaaggucauuuaccucgugaugaucguacugauuguuccggcauacagcaucuccugcauaggcgugucaaaccgggaccuggucgaaggcaugagugggggaacuuggguggaugugguccucgagcacgguggcuguguuaccgaaauggcccaggacaaacccacaguggauauugaguuaguaaccaugacggugagcaauauggcugagguccgcucuuauugcuacgaagccucccugucagacauggcgagcgcaagucgauguccuacucaaggggagccaucucuugauaagcaguccgacacacagagcgugugcaaaagaaccuugggagacaggggcugggguaacggguguggaaucuuuggcaagggcucgcugguuacuugcucuaaauucacaugcuguaagaagaugcccgggaaauccauucagccugaaaaucuagaguaucggaucaugcucccagugcacggaucacaacauagugguaugaucgucaacgauauuggccacgaaaccgacgagaaucgugccaagguggagguaacgcccaacagcccucgcgcugaagccacccugggaggguuuggcucccuuggucuggauugcgagccaagaacaggguuggacuucucugaucucuacuaucugacuaugaauaacaaacauugguuaguucacaaggaaugguuucacgacauaccgcugcccuggcaugcaggcgcugauaccggaacaccucacuggaauaacaaagaggcccucguggaguucaaggacgcgcaugccaaaaggcagacugucgugguccuuggcagccaggaaggggcagugcacaccgcucuggccggagcuuuggaggccgaaauggauggugcaaagggccggcuauuuucagggcaucugaagugucgacucaaaauggacaagcugcgccuuaaaggaguuaguuacucccugugcacagccgcuuucaccuuuacuaaggugccagcggagacguugcacggcacaguaaccgucgaagugcagagcgcagguacugaugggcccuguaaaguuccugcccaaauggcuguggacaugcagacccucacaccagucggcagacugaucaccgccaaucccgugauuacugagucuacagaaaacucaaagaugauguuagagcuggacccgccuuucggagauaguuauaucguaauaggcgugggggacaagaaaauuacgcaccauuggcacaggagcggauccaccaucgguaaggcauuugaggccacuguucggggcgcuaaacgcauggccguccuaggggauacagcaugggacuucggaucugugggcgguguguucaacucgcucgggaagggcauccaucagauuuuuggagcggcuuucaaaagccuguuuggcgggauguccugguucucacaaauccuuauuggaaccuugcuggucuggcucggccugaauacaaagaacgguaguauaucucuuacuugccuggcccucgggggaguuaugaucuuuuugagcaccgcaguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6279 - RNA, 2446 nt, Artificial Sequence
  KX447520.1 prME-short mRNA Design 2 opt
ggggcgcugccuacggagguggcagccaucuccuucucggcaucaagcuuaccaugagcgugggcaucgucgggcugcuccuuaccacagccauggcugcagagguuacuagaaggggauccgccuacuauauguaccuggaccggaacgaugcgggugaagcuauuucuuuccccacgaccuugggcaugaauaagugcuauauacagaucauggacuuagggcacaugugugaugccacaaugucauacgagugcccuaugcuggacgaaggaguggagccagaugacguagauuguuggugcaacacuaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6280 - RNA, 2449 nt, Artificial Sequence
  KU761561.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuagaaggauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6281 - RNA, 2449 nt, Artificial Sequence
  KX806557.2 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauguuuaggaaccccggguucgcucuggcagccgcugccaucgcgugguugcucggaagcaguacaucccagaaagugauuuaucuggucaugauccugcucauagcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauuucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauccagccugaaaaccucgaguaccguauaaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauauuccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaaucacagccaacccaguuauuacggagaguaccgaaaacuccaagaugaugcuggagcuagaucccccguucggcgacagcuacauagugaucggagucggcgagaaaaagauuacucaccacuggcaucggucugggucaacaaucggaaaggcauuugaagccaccgugcgcggugcuaaaagaauggccguacucggcgauacagcaugggacuucgggagugugggaggcgcucugaauagccuugguaaggggauacaccagauuuucggcgccgcguuuaaauccuuguucggaggcaugucuugguuuucgcaaauccugaucgggacucuccugauguggcuuggacugaacaccaagaauggcagcauuuccuugaugugucucgcccugggugggguuuuaaucuuccugucaacggcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6282 - RNA, 2449 nt, Artificial Sequence
  LC191864.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaugaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6283 - RNA, 2449 nt, Artificial Sequence
  KU744693.1 prME-short mRNA Design 2 opt
ggggcgcugccuacggagguggcagccaucuccuucucggcaucaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgcuauggcccaggacaagccaacaguggauauugagcuggucaccacgacuguuucaaacauggcagaggugcgaaguuacugcuaugaagcuagcaucucugacauggccuccgauucaagaugucccacacaaggggaggcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauacagccugaaaaccucgaguaccguauuaugcugagcgugcacgggucgcaacacucuggaaugcuuguuaaugacacgggucaugaaaccgaugagaaccgcgcuaagguggagaucacaccaaauucccccagagccgaagcuacucugggcggguucggaucauugggccucgacugugagccuaggaccggucuggauuuuagugacuuauauuaccugacaaugaacaauaaacacuggcucgcccauaaggaaugguuccacgauauuccacuuccguggcacgcaggggccgcuacuggcaccccucauuggaacaauaaagaggcgcuggucgaauuuaaggacgcacacgccaaacggcagacagugguaguuuugggaagccaggagggcgcugugcauaccgcccuagcaggggcccuggaggcugaaauggauggagccaagggucgacucuccucuggccaccugaaaugccgccuuaagauggacaagcugagauugaaaggggucagcuauucacucuguacugcagcguucacguuuacaaagaucccugcugagaccguggauggaacugucaccguggaaggccaguacggugggacagacggcccaugcaaaguucccgcccaaauggcaguggacaugcagacccugacuccuguaggaagguuaaucacagccaacccagucauuacggagaguaccgaaaacuccaagaugaugcuggagcuagaucccccguucggcgacagcuacauagugaucgggguuggagagaaaaagauuacucaucacuggcaccggucugguucaacaaucggcaaggcuuuugaagccaccgugcgcggggcaaaaagaauggcuguccucggagauacagccugggacuucggcaguguggguggggcgcugaauagccuuggcaagggaauacaucagauuaucggcgccgcuuucaaauccuuguuugggggaaugucuugguucucgcaaauccugauuggcacucuccugauguggcuuggucugaacaccaagaaugggagcaucuccuugaugugucucgcacugggaggcguauuaauuuuucugucaacggccgugagugguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6284 - RNA, 2440 nt, Artificial Sequence
  KU963574.2 prME-short mRNA Design 2 opt
ggggcgcugccuacggagguggcagccaucuccuucucggcaucaagcuuaccaugggcgccgacgcuagcaucgggauugugucccugcuccuuaccacagucauggcagccgagauaacuagaaggggaucugcguacuauauguaccuggaucggucagacgcugguaaggccaucaguuucguuacgaccuugggcgugaacaaaugccacguacagauuauggauuuagggcauaugugugacgcaacaaugagcuaugaaugccccaugcuggaugagggaguggaaccugacgaugucgacuguuggugcaauacuaccuccacaugggugguuuacggcaccugucaccauaagaaaggugaggcccgccgaucucguagagcugugacucuaccaucgcacucaacaaggaagcuccaaacccggagccagacguggcuggaaagucgcgaguauacuaaacaucuuaucaaggucgagaacuggauuuuuagaaauccgggguucgcacugguggccguagcuaucgccugguugcucggauccucuaccagccagaagguuauauaccuggugaugauccugcucauugcgcccgcauauuccaucaggugcauuggcgucucaaaccgggauuuuguggaaggcaugagugggggaacauggguggacgucguuuuagagcacgguggcugugugacuguaauggcccaggauaaaccuaccguggacaucgaacuggucacaaccacggugagcaauauggcugagguucgcucuuacugcuacgaggccuccauaucagauauggcaagcgacagucgauguccaacucaaggggaggcuuaucuugacaagcagucugauacacaguacgugugcaaaagaaccuuggucgacaggggauggggcaacgguugugggcuguucggaaagggcucccuagugacuugcgccaaauuuacaugcagcaagaagaugaccggcaaaucgauucagcccgaaaaucucgaauaucggaucaugcugucuguacacgggucccaacauucaggaaugauuguuaacgaugagaaucgugcgaagguggaagucacgccuaacaguccacgcgccgaggcaacccuugguggcuucgggagccugggauuggacugugagcccagaacaggccucgauuuuuccgaccuguacuauuuaacuaugaauaacaaacacuggcuggugcauaaggaaugguuccacgauaucccucucccauggcacucuggugcugacaccgagacaccgcauuggaauaacaaagaagcccuugucgaguuuaaggaugcucacgccaaaaggcagacugugguugugcuggggagccaggaaggcgcaguacauaccgccuuggcuggagcgcuagaggcagagauggacggcgccaaggggcggcugucaaguggacaccucaagugccgacugaaaauggauaaacuucgccugaagggugucuccuacagcuuguguacagcugccuucaccuuuacuaaggugcccgcagaaacgcuccauggcacaguuaccguggagguccaguaugccgggagagacggaccuugcaaagugccagcucaaauggccguagacaugcagacucugacccccgugggcagguuaaucacagcaaauccuguuauuaccgaaucuacugagaacucaaagaugaugcuggaacuagauccacccuucggugacaguuacauagucaucggggugggcgauaagaaaauuacacaccacuggcaucggagcggauccaucauaggcaaggcguuugaggcuacggugcgcggggccaaaagaauggcaguccucggagacaccgccugggauuucgguucuguuggcgggguguucaacucgcugggaaagggcauucaccagaucuuuggugcugccuucaaaagccuuuuugggggcauguccugguucucacaaaucuugauuggaacucugcucguguggcugggccuuaauacaaagaacgggaguaucucucugaccuguuuggcacucggaggcguaaugauuuuucugagcacagcugucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6285 - RNA, 2458 nt, Artificial Sequence
  KF383120.1 prME-short mRNA Design 2 opt
ggggcgcugccuacggagguggcagccaucuccuucucggcaucaagcuuaccaugggcgccgacaccagcaucgggauuauaggacugcuccuuacaacugcuauggcagccgagaucacgagaagggguuccgcguacuauauguaccuggaucggucugacgcuggcaaggccauuucauucgcaaccacaaugggggugaacaaaugccacguccagaucauggauuugggacauaugugugacgccacuaugaguuaugaaugccccauguuagaugagggcguugaaccugacgauguggacuguuggugcaauaccacaagcaccuggguaguguacgguacuugucaccauaagaaaggggaggcucgcccaucccgacgugcagucacacugccgucucacucgaccagaaagcuacaaacgaggucacagacuuggcucgaaagccgggaguauaccaaacaucugauuaagguggagaacuggauccuucgcaaucccggauuuacaguugccgcucuggccauggcgugguugcucggcaacaguacuucccagagagugauauaccuggucaugauccugcucauugcacccgccuauucuaucaggugcauuggcgugagcaaucgggauuucguagaagggauguccggagguaccuggguugacguggucuuagagcacggcgggugugugacagugauggcucaggauaagccaaccgucgacaucgaacugguuacgacuacagugucaaacauggccgagguacgcaguuacugcuacgaggcaagcauaucugauauggcuuccgacucacgaugucccacccaaggagaagccuaucuugacaaacagagcgauacucaguacgugugcaagagaacauuggucgacaggggcugggguaauggguguggacuguuuggcaaaggcagucuagugaccugcgcgaaguucacgugcucuaaaaagaugaccgggaaguccauucagccugagaaccucgaauaucggaucaugcugagcguucacggaucgcaacauucugguaugauugugaaugauaucggccacgagacagacgaaaaccgugccaaagucgaggugacuccaaauuccccucgcgcagaggcuacccuugggggauuuggcucacuggguuuggauugugaaccuagaacagggcucgacuucagugaucuguacuauuuaacuaugaacaauaagcauuggcugguacacaaagagugguuucacgacaucccacucccguggcaugccggcgcugauaccggaacaccccacuggaacaauaaggaagcccuuguugaguucaaagacgcacaugccaagaggcagaccguggucgugcugggcagccaggaaggggcuguccacacugcguuggcaggagcccuagaggcugagauggauggugccaaaggccggcuguuuuccgggcaucucaagugccgaauuaagauggacaaacugcgccuuaagggagugucuuacagccuguguacggcagccuucacauuuucaaaaguuccugcugaaaccuugcacggcacugugaccguagagguccaguaugccgguagagacgggccaugcaaggugcccgcacaaauggcgguugauaugcagacacucaccccugugggcaggcugauaacugcuaacccaaucauuacagaaaguacggagaacucccggaugauguuagaacuggaucccccguucggagacagcuacaucgucauaggcgugggggacaaaaagauuacccaccauuggcaccgcucuggaucaacuaucgguaaggccuuugaggcaacaguaagaggcgccaaaaggauggcugugcuaggggauaccgccugggacuucggaaguguuggcggugucuucaauagccucgggaagggcgugcaucagguguuuggagcagcuuucaaaucccuguuuggcgggaugucuugguucucgcaaauccuuauuggaacauugcuggucuggcucggccugaacacuaagaaugguagcaucucccuugccugucuggcguugggaggggccaugauuuuucucucaaccgcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6286 - RNA, 1741 nt, Artificial Sequence; identical to SEQ ID NO: 6061
  KU321639.1 solE mRNA Design 2 opt

SEQ ID NO: 6287 - RNA, 1741 nt, Artificial Sequence; identical to SEQ ID NO: 6062
  KU312312.1 solE mRNA Design 2 opt

SEQ ID NO: 6288 - RNA, 1729 nt, Artificial Sequence; identical to SEQ ID NO: 6063
  AY632535.2 solE mRNA Design 2 opt

SEQ ID NO: 6289 - RNA, 1741 nt, Artificial Sequence; identical to SEQ ID NO: 6062
  KU527068.1 solE mRNA Design 2 opt

SEQ ID NO: 6290 - RNA, 1741 nt, Artificial Sequence
  KX421193.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6291 - RNA, 1741 nt, Artificial Sequence
  LC002520.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaccgugaacgauaucggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6292 - RNA, 1723 nt, Artificial Sequence
  DQ859059.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacgccggggcugacacaggaacuccacacuggaauaacaaagaagcccuuguagaguucaaggacgcgcaugcaaagagacagaccguggucguguugggcucccaggaaggcgccguucacacagcucuggccggggcacuagaggcugaaauggauggagccaaagguaggcucuuuucaggccaucugaagugucggcuuaaaauggacaagcugcgcuugaaaggggugagcuacagucucugcaccgcggccuucacguuuacuaagguccccgcagagacacugcacggaaccgugacuguagagguucaauaugcuggcacagaugguccuuguaaagugccagcccagauggcugucgacaugcagaccuuaacgccgguggggcgacugaucaccgccaaucccgucauuacagaaucuacugagaacuccaagaugaugcucgaacuugauccuccauucggcgacagcuacaucgugauaggaguuggcgauaagaaaauuacccaccauuggcacagaucggggucuacaaucggaaaggcauuugaggccacugugaggggugcuaaacggauggcgguacugggcgacaccgcaugggauuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6293 - RNA, 1729 nt, Artificial Sequence
  KU963573.2 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugagaacagggccaagguggaagucacgcccaauaguccucgggcugaggcaacucugggaggguuuggcagcuugggucucgacugcgagccacgcaccgggcuggauuucucugaccuguacuaccucacaaugaacaauaaacauugguuaguucacaaggaaugguuucaugauauuccccugccuuggcacgccggagcugacacuggcaccccacacuggaacaauaaagaggcccuuguggaguucaaggacgcgcaugcaaagagacagacaguaguggucuugggcucccaggaaggggccgugcacaccgcucuggccggagcacuagaagcugagauggauggugccaaaggcaagcucuuuucagggcaucugaaauguaggcuuaagauggacaaacugcgguugaagggaguuagcuauagucucugcacggcggccuucacuuuuacaaaagugcccgcagagacccugcacggcacugucacaguggaaguacaauacgcugguaccgaugggccuuguaagaucccaguucagauggccguggacaugcagacguuaaccccggucggccgccugauuacagcuaaccccgugaucacugagucuaccgaaaauuccaagaugaugcucgagcuugauccuccauucggagacagcuauauagucauuggcgugggggauaaaaagaucacacaccauuggcaccgaucgggaucuacuauugguaaagccuuugaagcaaccguuagaggcgccaagaggauggcugugcugggggacacagcgugggauuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6294 - RNA, 1741 nt, Artificial Sequence
  KY075939.1 solE mRNA Design 2 opt
ggggcgcugccuacggagguggcagccaucuccuucucggcaucaagcuuaccaugagccagaaggugaucuaccuggucaugauucuccuuauagcccccgcuuauucccugagaugcaucggcguuucuaacagggacuucguggaggggaugucaggagguaccuggguagauguggucuuggaacacggcgggugugugacaguuauggcacaagacaaaccuacuguggauauugaguuagucacgaccacagugaguaauauggccgaaguacggagcuacugcuaugaggcguccaucucugacauggcuucggauucacgcuguccaacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauucaaccggagaaucuugaguacagaaucaugcugagcguccauggaucccagcacucagguaugauagugaacgauacaggccaugaaaccgacgagaauagggcuaaggucgaaaucacgcccaacaguccucgggcagaggccacucuagggggauuuggcagccucggucuggauugcgagccacgcaccgggcuggacuucucugaucucuauuacuuaacaaugaauaacaaacacuggcugguucauaaggaaugguuucacgacauuccccuuccuuggcacgcuggagccgacacuggcaccccacauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauccccgcugagaccuuacacggcacugugacagucgaagugcaauaugccgguaccgacgggccuuguaaaguaccagcucagauggccguugauaugcagacgcugaccccggugggccgacucauuacagcaaaucccgucaucacugaguccaccgaaaacagcaagaugaugcuugagcuggacccuccauuuggagauucguacauagugauuggcgucggggaaaagaaaaucacacaucacuggcauagaucuggauccacuauugguaaggccuucgaggcuaccgugaggggcgcgaaacggauggcaguuuugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6295 - RNA, 1741 nt, Artificial Sequence
  KX447516.1 solE mRNA Design 2 opt
ggggcgcugccuacggagguggcagccaucuccuucucggcaucaagcuuaccaugagcaagaaagugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaggacaagccuacuguggauaucgaguuggucacgaccacagugaguaauauggccgaaguacggagcuacugcuaugaggcguccauuucugacauggcuucggauucacgcuguccaacucaaggagaagccuacuuagacaaacagagcgauacccaguauguuugcaagcgaacacugguggaccguggcugggguaacggguguggacuauuuggcaaaggcagucucgugaccugcgcaaaguucgccuguuccaagaaaaugacugggaagucuauccagccggagaaucuggaguacagaauaaugcuuagcguccauggaucccaacacucagguaugaucgugaacgauacaggccaugaaaccgacgagaauagggcuaaagucgaaauuacgcccaacaguccucgggcagaggccacucugggaggguuuggcagcuugggucucgauugcgagccacgcaccgggcuggacuucucugaucuguauuaccucacaaugaauaacaagcacugguuaguucauaaagaaugguuucacgacaucccccugccuuggcacgcuggagccgacacuggcaccccacauuggaauaacaaggaggcgcuuguggaguucaaggaugcacacgccaaaagacagacaguaguggucuugggcucccaggaaggggcugugcauaccgcccuggcaggagcucuagaagccgagauggacggugcgaagggcaggcucucaagcgggcaccugaaaugucggcuuaagauggauaaacugcgcuugaagggaguuaguuacucucucugcacggccgcauuuacuuucacaaaaauucccgcugagacccugcacggcacugugacagucgaagugcaguaugccgguaccgacgggccuuguaagguaccagcucaaauggccguugauaugcagacguuaaccccggugggccgacugaucacagcaaaucccgucauaacugaguccaccgaaaacagcaagaugaugcucgagcuugacccuccauuuggagauucguacauugugaucggcgucggggagaaaaagauuacacaucacuggcauagaucuggauccacuaucgguaaagccuucgaagcuaccgugaggggcgcgaagcggauggcaguucugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6296 - RNA, 1741 nt, Artificial Sequence
  KX447515.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacugguauagaucuggauccacuaucgguaaggccuucgaggcuaccgugaggggcgcgaaacggauggcaguucugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6297 - RNA, 1741 nt, Artificial Sequence
  KU758874.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaagcucucaagcgggcaccugaaauguaggcuuaagauggauaaacugcgguugaagggaguuaguuacucucucugcacggccgcauuuacuuucacaaaaauucccgcugagacccugcacggcacugugacagucgaagugcaauaugccgguaccgacgggccuuguaagguaccagcucagauggccguugauaugcagacguuaaccccggugggccgccugaucacagcaaaucccgucauaacugaguccaccgaaaacagcaagaugaugcucgagcuugacccuccauuuggagauucguacauugugaucggcgucggggagaaaaagauuacacaucacuggcaucgaucuggauccacuaucgguaaagccuucgaagcuaccgugagaggcgcgaagaggauggcaguucugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6298 - RNA, 1741 nt, Artificial Sequence
  KU729218.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauacgcagaccuuaacaccggugggccgacugaucacugcaaaucccgucauaaccgaguccacagaaaacagcaagaugaugcucgagcuugacccuccauuuggagauucguacauugugaucggcgucggggaaaagaaaauuacucaucacuggcauagaucuggauccaccaucgguaaggccuucgaggcuacagugaggggcgcgaaacggauggcaguucugggggacaccgccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6299 - RNA, 1741 nt, Artificial Sequence
  KU501217.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaauucggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6300 - RNA, 1741 nt, Artificial Sequence
  KU761561.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgcggcguauggcaguucugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6301 - RNA, 1741 nt, Artificial Sequence
  KY075937.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacaugguuucggauucacgcuguccaacucagggagaggcuuacuuagacaagcagagcgauacccaguaugugugcaaacgaacacuggucgaccguggcugggguaacggguguggacuauuuggcaagggcagucucgugaccugcgccaaauucgcauguuccaagaagaugacugggaaaucuauccaaccggaaaaucuggaguacagaauaaugcuuagcgugcauggaucccagcacucagguaugaucgucaacgauacaggccaugaaaccgacgagaauagggccaagguugaaauuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6302 - RNA, 1741 nt, Artificial Sequence
  KY014317.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccauugaaaacagcaagaugaugcucgagcuugacccuccauuuggagauucguacaucgugauuggcgucggggaaaagaaaaucacccaucacuggcauagaucuggauccacaaucgguaaggccuucgaggcuacugugaggggcgcgaaacggauggcaguucugggggacaccgccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6303 - RNA, 1741 nt, Artificial Sequence
  KU870645.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcauuggggaaaagaaaaucacacaucacuggcauagaucuggauccacuaucgguaaggccuucgaggcuaccgucaggggcgcgaaacggauggcagugcugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6304 - RNA, 1741 nt, Artificial Sequence
  KU922923.1 solE mRNA Design 2 opt
ggggcgcugccuacggagguggcagccaucuccuucucggcaucaagcuuaccaugagccagaaggugaucuaccuggucaugauucuccuuauagcccuggcuuauuccaucagaugcauuggcguuucuaacagggacuucguggaggggaugucaggagguaccuggguagauguggucuuggaacacggcgggugugugacaguuauggcacaagacaaacccacuguggauaucgaguuagucacgaccacagugaguaauauggccgaaguacggagcuacugcuaugaggcguccauuucugacauggcuucggauucacgcuguccuacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauccaaccagagaaucuugaguacagaauaaugcugagcguccauggaucccagcacucagguaugaucgugaacgauacaggccaugaaaccgacgagaauagggcuaaggucgaaauuacgccgaacaguccccgggcagaggccacucuagggggauuuggcagccucggucuggauugcgagccucgcaccgggcuggacuucucugaucucuauuacuuaacaaugaauaacaaacacuggcugguucauaaggaaugguuucacgacaucccacuucccuggcacgcuggagccgacacuggcaccccucauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauuccagcugagaccuuacacggcacugugacagucgaagugcaauaugccgguaccgacgggcccuguaaaguaccugcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6305 - RNA, 1741 nt, Artificial Sequence
  KU497555.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcacccaggaaggggcugugcauacggcccuggcaggagcucuagaagccgagauggacggugcgaaaggcaggcucuccucagggcaccugaagugucggcuuaaaauggauaagcugcgcuugaaaggaguuagcuacagucucugcacugccgcauuuacauucaccaagauucccgcugagacucugcacggcacagugaccgucgaagugcaauaugccgguacggacgggccuuguaaaguaccagcucagauggccguugauaugcagaccuuaacaccggugggccgacugaucacugcaaaucccgucauaaccgagucuacagaaaacuccaagaugaugcucgagcuugacccuccauuuggagauagcuacauugugaucggcgucggggaaaagaaaauuacucaucacuggcauagaucgggaucuaccaucgguaaggccuucgaggcuacagugaggggcgcgaaacggauggcaguucugggggacaccgccugggauuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6306 - RNA, 1741 nt, Artificial Sequence
  KU312314.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguauuagcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6307 - RNA, 1741 nt, Artificial Sequence
  KY014314.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaagcacacgccaagagacagacaguaguggucuugggcucccaggaaggggcugugcauaccgcccuggcaggagcucuagaggccgagauggauggugcgaaaggcaggcucucaagcgggcaccugaagugucggcuuaaaauggacaagcugcgcuugaaaggaguuaguuacucucucugcacggccgcauuuacuuucacaaagauucccgcugaaacccugcacggcacugugacagucgaggugcaauaugccgguaccgaugggccuuguaaaguaccagcucagauggccguugacaugcagacguuaaccccggugggccgacugaucacagcaaaucccgucauaacugaauccaccgagaacagcaagaugaugcucgaacuugauccuccauuuggagacucguacauugugaucggcgucggggagaagaaaauuacacaucacuggcauagaucuggauccacuaucgguaaggccuucgaggcuaccgugaggggcgcgaaacggauggcaguucugggggauacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6308 - RNA, 1741 nt, Artificial Sequence
  KX447517.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccgcucugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6309 - RNA, 1741 nt, Artificial Sequence
  KU729217.2 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucaguacgaccgugagcaauauggccgaaguacgguccuacugcuaugaggcgacaauuucugacaucgcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaaggucgaaaucacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacauuccccugccuuggcacgcuggagccgacacuggcaccccacauuggaauaacaaagaggcgcuuguggaguucaaggaugcacacgccaagagacagacagcuguaguguugggcucccaggaaggggccguccauaccgcacuggcuggagcccuagaagcggagauggacggugccaaaggcaggcucucaagcgggcaccugaagugucggcuuaaaauggauaagcugcgcuugaaaggagugaguuacucucucugcacggcagcuuuuacuuucacaaagauccccgccgagacccugcacggcacuguuacaguggaaguccaauaugcugguaccgacgggccuuguaaagugccagcccagauggcaguagauaugcagacguuaaccccgguuggccgacugauaacagccaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggcuuucgaggcgaccgucaggggcgcaaaacggauggccgugcugggggacacagcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6310 - RNA, 1741 nt, Artificial Sequence
  KY328290.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucuccaagauucccgcugagacacugcacggcaccgugacugaagagguccaauaugccgguacagacgggccuuguaaagugccagcucagauggccguagauaugcagaccuuaacgccgguuggccgacugaucaccgcaaaucccgugauaacagaaagcacugagaacucgaagaugaugcucgaacuugacccuccauuuggagauucuuacauugucaucggcgugggggagaagaaaauuacccaucacuggcauagauccggaucaacaaucgguaaggccuucgaggcuacugucaggggcgcgaaacggauggcagugcugggggacaccgccugggauuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6311 - RNA, 1741 nt, Artificial Sequence
  KX087101.3 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaauuacaauaugccgguaccgacgggccuuguaaagugccagcucagauggccguagauaugcagacgcugaccccgguuggccgacucaucacagcaaaucccgugauaacugaguccaccgaaaacagcaagaugaugcuugagcuggacccuccauuuggagauucguacauugucaucggcgugggggaaaagaaaauuacacaucacuggcauagaucuggauccacuaucgguaaggccuucgaggcuaccgucaggggcgcgaaacggauggcaguguugggggacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6312 - RNA, 1741 nt, Artificial Sequence
  KY003156.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcaucucuaacagggacuucguugaggggaugucaggagguaccuggguggauguagugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcauuuugggucucgauugcgagccacgcaccgggcuggacuucagcgaucuguauuaccucacaaugaauaacaaacacugguuaguccauaaggaaugguuucacgacaucccccugccuuggcacgcuggagccgacacuggcaccccacauuggaauaacaaagaggcgcuuguugaguucaaggaugcacacgccaagagacagacagugguaguguugggcucucaggaaggggcuguccauaccgcccuggcaggagcucuagaagccgagauggacggugcgaaaggcaggcucuccucagggcaccugaagugucggcuuaaaauggauaagcugcgcuugaaaggagugagcuacagucucugcacggccgcauuuacuuucacaaagauacccgcugagacccugcacggcacuguuacaguggaaguccaauaugccgguaccgacgggccuuguaaagugccagcucagauggccguagauaugcagacguuaaccccgguuggccgacugauuacagcaaaucccgugaucacugagucuaccgaaaacuccaagaugaugcucgagcuugacccuccauuuggagauagcuacauugucaucggcgugggggaaaagaaaaucacacaucacuggcauagaucgggaucuacuauugguaaggccuucgaggcuaccgucaggggcgcgaaacggauggcagugcugggggacacagccugggauuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6313 - RNA, 1741 nt, Artificial Sequence
  KU758876.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacgguguuaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6314 - RNA, 1741 nt, Artificial Sequence
  KU926310.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccggugcugacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6315 - RNA, 1741 nt, Artificial Sequence
  KU681081.3 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacacuggagcugacaccggcacaccacauuggaauaacaaagaggcccuuguggaguucaaggaugcgcacgcaaagagacagaccguaguggucuugggcucccaggaaggggccgugcauacggcucuggccggagcacuagaagcugagauggacggugccaaaggcaggcucucaagcgggcaccugaagugucggcuuaaaauggauaagcugcgcuugaaaggaguuaguuacucucucugcacugcggccuuuacauucaccaagauucccgcagagacucugcacggcacagugaccgucgaagugcaauaugcugguacggacgggccuuguaaaguaccagcccagauggcuguugauaugcagaccuuaacaccggugggccgacugaucacugccaaucccgucauaaccgagggaacagaaaacuccaagaugaugcucgagcuugacccuccauuuggcgauagcuacauugugaucggggucggagaaaagaaaauuacucaucacuggcauagaucggguucuaccaucggcaaggcauucgaggccacagugaggggagcuaaacggauggcgguucugggggacaccgcaugggauuuuggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6316 - RNA, 1741 nt, Artificial Sequence
  KU744693.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacagcaauggcccaagacaaaccuacuguugauaucgaguuggugacgaccacagucaguaauauggcggaagugcggagcuacugcuaugaggcuuccauuucugacauggccucggauucacgcuguccaacucagggagaagcauacuuagacaagcagagcgauacccaguauguaugcaaacgaacacugguugaccguggcugggguaacggguguggacuauuuggcaagggcagucucgugaccugcgccaaauucgcuuguuccaagaagaugacugggaaaucuauccaaccggagaaucuggaguacagaauaaugcuuagcguccauggaucccagcacucagguaugcuggugaacgauacaggccaugaaaccgacgagaauagggcaaagguggaaaucacgcccaacaguccucgggccgaggcuacucucgggggauuuggcagcuugggucuggauugcgagccacgcaccgggcuggacuucucugaucucuauuacuuaacaaugaauaacaaacacuggcuggcccauaaggaaugguuucacgacauuccccuuccuuggcacgcgggagcagccacuggcaccccacauuggaauaacaaagaggcuuuggucgaguucaaggacgcccacgcaaagagacagacaguugugguacugggcucccaggaaggggcugugcauaccgcccuagcgggagcccucgaagcagagauggauggugcuaaaggcaggcugucaagcgggcaccuuaagugucggcugaaaauggacaaguugcgccucaaaggagucaguuacucucugugcacggccgcuuuuacuuucacaaagauccccgccgagaccguggauggcacuguuacaguggaaggucaauaugggggcaccgacggaccuuguaaagucccagcacagauggccguggauaugcagacguuaaccccgguaggccgacugauuacagcuaaucccguuaucacugaguccaccgaaaacagcaagaugaugcucgagcuugacccuccauuuggggauucguacauagugauuggagucggugaaaagaaaaucacacaccauuggcacagaucuggcuccacuauugggaaggcguucgaggcaaccgugaggggagccaaacggauggcuguccugggcgacacagccugggauuuugguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6317 - RNA, 1741 nt, Artificial Sequence
  EU545988.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccugccguggauaucgaguuggucacuacgaccgugaguaauauggcggaaguacggagcuacugcuaugaggcuuccauuucugacauggccucggauucacgcuguccaacacagggagaagcauacuuagacaagcagagcgauacucaguauguuugcaaacgaacccugguggaccguggcugggguaacggguguggacuauuuggcaagggcagucucgucacaugcgccaaauucgcuuguuccaagaagaugaccgggaaaucuauccaaccggagaaucuggaguacagaauaaugcuuagcgugcauggaucccagcacucagguaugaucgugaacgauacuggccaugaaacagacgagaauagggcaaaggucgaaauuacccccaacaguccucgggccgaggcuacgcugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6318 - RNA, 1741 nt, Artificial Sequence
  KY007221.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuaacaauagggacuucguggaggggaugucuggagguaccuggguagaugugguccuggaacacggcgggugugugacaguuauggcacaagacaaaccuacuguggauaucgaguuggucacgaccacagugucaaacauggccgaaguacggaguuacugcuaugaggcgagcauuuccgacauggcuucugauucgcgcuguccaacucagggagaagccuacuuagacaagcagucagauacccaguauguuugcaaacgaacacugguggaccguggcugggguaauggguguggacuauuuggcaagggcagccucgugaccugcgcaaaauucgccuguaguaagaagaugacugggaaauccauccaaccggagaaccuggaguacagaauaaugcuuucuguccauggaagccagcacuccgguaugaucgugaaugauacaggccaugaaaccgacgagaacagggcuaaggucgaaauuacgcccaauucaccucgggcagaggccacucugggaggguuuggcaguuugggucucgauugcgagccacgcaccgggcuggacuucagcgaucuguauuaccucacaaugaacaauaaacacugguuaguucauaaggaaugguuucacgacaucccccugccuuggcacgcuggagccgacacuggcaccccacauuggaacaauaaagaggcgcuuguggaguucaaggaugcacacgccaagagacagacaguaguggucuugggcucucaggaaggggcugugcauaccgcccuggcaggagcucuagaagccgagauggacggugcgaaaggcaggcucuccucagggcaccugaagugucggcuuaaaauggauaagcugcgcuugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaccccgucauaacugagucuaccgaaaauuccaagaugaugcucgagcuugacccuccauuuggagauagcuacauugugaucggcgucggggaaaagaaaauuacacaucacuggcauagaucgggaucuacuaucgguaaggccuucgaggcuaccgugaggggcgcgaaacggauggcaguucugggggacacagccugggauuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6319 - RNA, 1741 nt, Artificial Sequence
  KY003152.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcgccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6320 - RNA, 1741 nt, Artificial Sequence
  KX694533.2 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauauuggccaugaaacagacgagaauagggcuaaggucgaaaucacccccaacaguccucgggcagaggccacgcugggaggguuuggcagcuugggucucgauugcgagccacgcacugggcuggacuucucugaucuguauuaccucaccaugaauaacaaacacugguuaguucauaaggaaugguuucacgacauuccccugccuuggcacgcuggagccgacacaggcacuccacauuggaauaacaaagaggcgcuuguggaguucaaggaugcacacgccaagagacagaccguaguggucuugggcucccaggaaggggcugugcauacagcccuggcaggagcucuagaagccgagauggacggugcgaaaggcaggcucucaagcgggcaccugaagugucggcuuaaaauggauaagcugcgcuugaaaggaguuaguuacucucucugcaccgccgcauuuacguucacuaagauccccgcugagacacugcacggcaccgugacugucgaagugcaauaugccgguacagacgggccuuguaaaguaccagcucagauggccguugauaugcagaccuuaacgccggugggccgacugauaaccgcaaaucccgucauuacagaguccacugaaaacagcaagaugaugcucgagcuugacccuccauuuggagauucguacaucgugauuggcgucggggacaagaaaaucacccaucacuggcauagaucuggauccacaaucgguaaggccuucgaagcuacugugaggggcgcgaaacggauggcaguucugggggauaccgccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6321 - RNA, 1741 nt, Artificial Sequence
  KX601167.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggacaagaaaauuacacaucacugguauagaucuggauccacuaucgguaaggccuucgaagcuaccgugaggggcgcgaaacggauggcaguucugggggauacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6322 - RNA, 1741 nt, Artificial Sequence
  KY288905.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggccaugaaacggacgagaauagggccaaggucgaaguuacucccaacaguccucgggcugaggcaacccugggaggguuuggcagcuugggucucgauugcgagccacgcacagggcuggacuucucugaucuguauuaccucacuaugaauaacaaacacugguuagugcauaaggaaugguuucacgacauuccccugccuuggcacgccggagcugacaccggcacaccacauuggaauaacaaagaggcccuuguagaguucaaggaugcgcacgcaaagagacagaccguggucguguugggcucccaggaaggggccguucauacggcucuggccggagcacuagaagcugagauggacggugccaaaggcaggcucuuuucagggcaccugaagugucggcuuaaaauggauaagcugcgcuugaaaggagugagcuacagucucugcacugcggccuucacauuuaccaagguccccgcagagacucugcacggcacagugaccguagaaguucaauaugcugguacggacgggccuuguaaagugccagcccagauggcugucgauaugcagaccuuaacaccggugggccgacugaucacugccaaucccgucauuaccgagucuacagaaaacuccaagaugaugcucgagcuugacccuccauucggagauagcuacaucgugauaggcguuggggacaagaaaauuacucaucacuggcauagaucgggaucuaccaucgguaaggcauuugaagccacagugaggggcgcuaaacggauggcgguacugggggauaccgcaugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6323 - RNA, 1741 nt, Artificial Sequence
  KF268950.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggccuucacuuuuacaaagguccccgcagagacccugcacggcacugugacaguagaaguucaauaugcugguaccgacgggccuuguaaagugccagcccagauggcugucgauaugcagacguuaaccccggugggccgacugauuacagccaaucccgucaucacugagucuaccgaaaacuccaagaugaugcucgagcuugacccuccauucggagauagcuacauagugauuggcguuggggacaagaaaaucacacaucacuggcauagaucgggaucuacuauugguaaggcauuugaagccaccgugaggggcgcuaaacggauggcgguacugggggauacagcaugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6324 - RNA, 1741 nt, Artificial Sequence
  KF383116.1 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggucuguacugccgcaaaggugcccgcugagacacugcacggcaccguaacuguugaagugcaauaugccgguacagacgggccuugcaaagucccagcucagauggccguggauaugcagaccuuaacgccggucggccgacugauuaccgcaaaucccgugaucacagagucuacugaaaacuccaagaugaugcucgagcuugacccuccauucggagauagcuacauaguuauuggcgugggggacaagaaaaucacccaucacuggcauagaucgggaucuacaauugguaaggccuuugaagcuacuguaaggggcgcgaaacggauggcaguccugggggauaccgccugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6325 - RNA, 1723 nt, Artificial Sequence
  KU963574.2 solE mRNA Design 2 opt
ggggcgcugccuacggagguggcagccaucuccuucucggcaucaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacuccggggccgacacagaaacuccacacuggaauaacaaagaggcucuuguagaguucaaggacgcccaugcgaagagacagaccguggucguguugggaucacaggaaggcgcaguucacacagcccuggcuggcgcccuagaagcagagauggauggggcuaaaggaaggcucagcaguggucaucugaagugucggcuuaaaauggacaagcugcgcuugaaaggcgugucuuacucccucugcaccgccgcguuuacguucacuaagguccccgccgagacacugcacgggaccgugacuguagaaguucaauaugcaggacgagauggcccuuguaaagugccagcucagauggccgucgacaugcagacauuaaccccgguggguagacugaucacggcuaaucccgucauuaccgagagcacagaaaacucgaagaugaugcucgagcuugauccuccauuuggggacucuuacaucgugauaggcguuggagauaagaaaauuacucaccauuggcacagguccggcucaaucauugggaaggccuucgaagcaaccgugcggggagccaaacguauggcuguacugggugacacagcgugggauuuuggcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6326 - RNA, 1741 nt, Artificial Sequence
  KF383118.1 solE mRNA Design 2 opt
ggggcgcugccuacggagguggcagccaucuccuucucggcaucaagcuuaccaugagccagaaggugaucuaccuggucaugauuguucucauagugcccgccuauuccaucucuugcauuggcguaucaaacagagaccuuguggaggggaugaguggagguaccugggucgaugugguucuggaacacggcgggugugugacagagauggcucaagacaaaccuacugucgauaucgaauuggugacgaugaccguaagcaauauggcagagguuagguccuacugcuaugaagccucuuuaucggacauggcgucagcuagccgguguccaacacagggagagccgagucuggauaagcaguccgacacucagucugugugcaaacgcacccuaggcgaucgagguugggggaacggauguggcauuuucggcaaggggagccucgucacaugcuccaaauuuaccuguugcaagaagaugcccggaaaaucaauccaaccugagaaucuggaauaccguauaaugcuuccagugcaugguagucagcacagcggcaugaucgugaacgacauugggcaugagacugaugaaaauagagccaaggucgagguuacacccaacucuccuagggcagaggccacccugggaggcuucgguuccuuggggcucgacugugaaccacggacgggacuggauuuuucagaccuguauuaccucacuaugaauaacaaacacugguuagugcauaaggagugguuccacgauaucccccugccuuggcacgcuggcgcagacaccggcacaccacauuggaauaacaaagaagcccuuguagaguuuaaggacgcucacgccaagcgccagacuguggucguguuggggagccaggaaggagcgguucauaccgcacuggccggugcucuagaggccgagauggauggcgcaaaagggagacucuucaguggacaccugaagugcaggcuuaaaauggacaagcugcgguugaaaggcgugucuuauucccucuguacagcugccuuuaccuucacgaaggucccggcggaaacucugcacgguacagugaccguagagguucaaagcgccgggacugauggccccugcaaagugccugcacagauggcugucgacaugcagacauuaaccccagugggacgccugauuacggccaaucccgucaucaccgaaucgacagagaacucuaagaugaugcucgaacuugauccuccauuuggcgacuccuacauagugauugggguuggagauaagaaaaucacucaucacuggcaucgaucagguaguaccauuggcaaggcuuucgaggccacagugagaggggcaaaaaggauggccguacugggagacacugcuugggauuuuggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6327 - RNA, 1741 nt, Artificial Sequence
  KX520666.1 solE mRNA Design 2 opt
ggggcgcugccuacggagguggcagccaucuccuucucggcaucaagcuuaccaugagacagaaggugaucuaccuggucaugauucuccuuauagcccccgcuuauagcaucaggugcauuggcguuuccaaccgggacuucguggaggggaugucuggagguaccuggguagaugugguccuggaacacggcgggugugugacaguuauggcacaagacaaaccuacuguggauaucgaguuggucacgaccacagugucaaauauggccgaaguacgcaguuacugcuaugaggcgagcauuuccgacauggcuucugauucgcgauguccaacucagggagaagccuacuuagacaagcagucagauacccaguauguuugcaaacguacacugguggacagaggcugggguaacggguguggacuauuuggcaagggcagccucgugaccugcgcaaaauucgccuguaguaagaagaugacugggaaauccauccaaccggagaaucuggaguacaggauaaugcuuucuguccauggaagccagcacuccgguaugaucgugaacgauacaggccaugaaaccgacgagaaucgggcuaaggucgaaauuacgcccaacucaccucgcgcagaggccacucugggaggguuuggcaguuugggucucgauugcgagccaagaaccgggcuggacuucagcgaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagaggcagacaguaguggucuugggcucucaggaaggggcugugcauaccgcccuggcaggagcucuagaagccgagauggacggugcgaaaggccggcucuccucagggcaccugaagugucgccuuaaaauggauaagcugcgauugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggcagacugaucacagcaaaucccgucauaacugagucuaccgaaaacuccaagaugaugcucgagcuugacccuccauuuggagauagcuacauugugaucggcgucggggaaaagaaaauuacacaucacuggcauaggucgggaucuacuaucgguaaggccuucgaggcuaccgugcggggcgcgaaacguauggcaguucugggggacacagccugggauuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6328 - RNA, 1741 nt, Artificial Sequence
  KF383120.1 solE mRNA Design 2 opt
ggggcgcugccuacggagguggcagccaucuccuucucggcaucaagcuuaccaugagccagagagugaucuaccuggucaugauucuccuuauagcccccgcuuauuccaucaggugcauuggcguuucuaaccgggacuucguggaggggaugucaggagguaccuggguagaugugguccuggaacacggcgggugugugacaguuauggcacaagacaagccuacuguggauaucgaguuggucacgaccacagugaguaauauggccgaaguacgcagcuacugcuaugaggcguccauuucugacauggcuucggauucacgauguccaacucagggagaagccuacuuagacaaacagagcgauacccaguauguuugcaagcguacacugguggacagaggcugggguaacggguguggacuauuuggcaaaggcagucucgugaccugcgcaaaguucacuuguuccaaaaagaugacagggaagucuauccaaccggagaaucuggaguacaggauaaugcuuagcguccauggaucccagcacucagguaugaucgugaacgauauuggccaugaaaccgacgagaaucgggccaaagucgaaguuacgcccaacaguccucgcgcugaggcaacucugggaggguuuggcagcuugggucucgauugcgagccaagaaccgggcuggacuucucugaucuguauuaccucacaaugaauaacaagcacugguuagugcauaaagaaugguuucacgacaucccccugccuuggcacgccggagcugacacuggcaccccacauuggaauaacaaggaggcccuuguagaguucaaagaugcgcacgcaaagaggcagacaguggucguguugggcucccaggaaggggccguucauaccgcucuggccggagcacuagaagcugagauggacggugccaagggccggcucuuuucagggcaccugaaaugucgcauuaagauggauaaacuucgacugaagggagugagcuacaguuugugcacggcggccuucacuuuuucuaaaguccccgcagagacacuccacggcaccgugacuguagaaguucaauaugcugguagagacgggccuuguaaggugccagcccagauggcugucgauaugcagacacugaccccggugggcagguuaaucacggccaaucccauaauuaccgaguccacagaaaacagccggaugaugcuggagcucgacccuccauucggagauucguacaucgucauuggcgugggggacaaaaagaucacucaucacuggcaucguucuggauccaccaucgguaaggcauuugaagccacaguucgcggcgcuaaaagaauggcggugcuuggggauacugcaugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6329 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6330 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6331 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6332 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6333 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6334 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6335 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6336 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6337 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6338 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6339 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6340 - RNA, 1741 nt, Artificial Sequence; identical to SEQ ID NO: 6338
  ZIKV (strain NatalRGN) Polyprotein(273-723) mRNA Design 2 opt

SEQ ID NO: 6341 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6342 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6343 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6344 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6345 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6346 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6347 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6348 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6349 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6350 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6351 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6352 - RNA, 2524 nt, Artificial Sequence; identical to SEQ ID NO: 6329
  ZIKV (strain ZikaSPH2015) Polyprotein(93-804) mRNA Design 2 opt

SEQ ID NO: 6353 - RNA, 2521 nt, Artificial Sequence
  ZIKV prME variant mRNA Design 2 opt
ggggcgcugccuacggagguggcagccaucuccuucucggcaucaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6354 - RNA, 2518 nt, Artificial Sequence
  ZIKV prME variant mRNA Design 2 opt
ggggcgcugccuacggagguggcagccaucuccuucucggcaucaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6355 - RNA, 2515 nt, Artificial Sequence
  ZIKV prME variant mRNA Design 2 opt
ggggcgcugccuacggagguggcagccaucuccuucucggcaucaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6356 - RNA, 2512 nt, Artificial Sequence
  ZIKV prME variant mRNA Design 2 opt
ggggcgcugccuacggagguggcagccaucuccuucucggcaucaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6357 - RNA, 2509 nt, Artificial Sequence
  ZIKV prME variant mRNA Design 2 opt
ggggcgcugccuacggagguggcagccaucuccuucucggcaucaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6358 - RNA, 2506 nt, Artificial Sequence
  ZIKV prME variant mRNA Design 2 opt
ggggcgcugccuacggagguggcagccaucuccuucucggcaucaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6359 - RNA, 2503 nt, Artificial Sequence
  ZIKV prME variant mRNA Design 2 opt
ggggcgcugccuacggagguggcagccaucuccuucucggcaucaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6360 - RNA, 2500 nt, Artificial Sequence
  ZIKV prME variant mRNA Design 2 opt
ggggcgcugccuacggagguggcagccaucuccuucucggcaucaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6361 - RNA, 2497 nt, Artificial Sequence
  ZIKV prME variant mRNA Design 2 opt
ggggcgcugccuacggagguggcagccaucuccuucucggcaucaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6362 - RNA, 2494 nt, Artificial Sequence
  ZIKV prME variant mRNA Design 2 opt
ggggcgcugccuacggagguggcagccaucuccuucucggcaucaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6363 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6364 - RNA, 2488 nt, Artificial Sequence
  ZIKV prME variant mRNA Design 2 opt
ggggcgcugccuacggagguggcagccaucuccuucucggcaucaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6365 - RNA, 2485 nt, Artificial Sequence
  ZIKV prME variant mRNA Design 2 opt
ggggcgcugccuacggagguggcagccaucuccuucucggcaucaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6366 - RNA, 2482 nt, Artificial Sequence
  ZIKV prME variant mRNA Design 2 opt
ggggcgcugccuacggagguggcagccaucuccuucucggcaucaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6367 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6368 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6369 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6370 - RNA, 2515 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6371 - RNA, 2515 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6372 - RNA, 2506 nt, Artificial Sequence
  ZIKV prME variant mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6373 - RNA, 2503 nt, Artificial Sequence
  ZIKV prME variant mRNA Design 2 opt
ggggcgcugccuacggagguggcagccaucuccuucucggcaucaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6374 - RNA, 2500 nt, Artificial Sequence
  ZIKV prME variant mRNA Design 2 opt
ggggcgcugccuacggagguggcagccaucuccuucucggcaucaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6375 - RNA, 2497 nt, Artificial Sequence
  ZIKV prME variant mRNA Design 2 opt
ggggcgcugccuacggagguggcagccaucuccuucucggcaucaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6376 - RNA, 2494 nt, Artificial Sequence
  ZIKV prME variant mRNA Design 2 opt
ggggcgcugccuacggagguggcagccaucuccuucucggcaucaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6377 - RNA, 2491 nt, Artificial Sequence
  ZIKV prME variant mRNA Design 2 opt
ggggcgcugccuacggagguggcagccaucuccuucucggcaucaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6378 - RNA, 2488 nt, Artificial Sequence
  ZIKV prME variant mRNA Design 2 opt
ggggcgcugccuacggagguggcagccaucuccuucucggcaucaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6379 - RNA, 2485 nt, Artificial Sequence
  ZIKV prME variant mRNA Design 2 opt
ggggcgcugccuacggagguggcagccaucuccuucucggcaucaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6380 - RNA, 2482 nt, Artificial Sequence
  ZIKV prME variant mRNA Design 2 opt
ggggcgcugccuacggagguggcagccaucuccuucucggcaucaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6381 - RNA, 2479 nt, Artificial Sequence
  ZIKV prME variant mRNA Design 2 opt
ggggcgcugccuacggagguggcagccaucuccuucucggcaucaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6382 - RNA, 2476 nt, Artificial Sequence
  ZIKV prME variant mRNA Design 2 opt
ggggcgcugccuacggagguggcagccaucuccuucucggcaucaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6383 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6384 - RNA, 2470 nt, Artificial Sequence
  ZIKV prME variant mRNA Design 2 opt
ggggcgcugccuacggagguggcagccaucuccuucucggcaucaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6385 - RNA, 2467 nt, Artificial Sequence
  ZIKV prME variant mRNA Design 2 opt
ggggcgcugccuacggagguggcagccaucuccuucucggcaucaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6386 - RNA, 2464 nt, Artificial Sequence
  ZIKV prME variant mRNA Design 2 opt
ggggcgcugccuacggagguggcagccaucuccuucucggcaucaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6387 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6388 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6389 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6390 - RNA, 2497 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6391 - RNA, 2497 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6392 - RNA, 2497 nt, Artificial Sequence
  ZIKV prME variant mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6393 - RNA, 2494 nt, Artificial Sequence
  ZIKV prME variant mRNA Design 2 opt
ggggcgcugccuacggagguggcagccaucuccuucucggcaucaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6394 - RNA, 2491 nt, Artificial Sequence
  ZIKV prME variant mRNA Design 2 opt
ggggcgcugccuacggagguggcagccaucuccuucucggcaucaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6395 - RNA, 2488 nt, Artificial Sequence
  ZIKV prME variant mRNA Design 2 opt
ggggcgcugccuacggagguggcagccaucuccuucucggcaucaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6396 - RNA, 2485 nt, Artificial Sequence
  ZIKV prME variant mRNA Design 2 opt
ggggcgcugccuacggagguggcagccaucuccuucucggcaucaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6397 - RNA, 2482 nt, Artificial Sequence
  ZIKV prME variant mRNA Design 2 opt
ggggcgcugccuacggagguggcagccaucuccuucucggcaucaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6398 - RNA, 2479 nt, Artificial Sequence
  ZIKV prME variant mRNA Design 2 opt
ggggcgcugccuacggagguggcagccaucuccuucucggcaucaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6399 - RNA, 2476 nt, Artificial Sequence
  ZIKV prME variant mRNA Design 2 opt
ggggcgcugccuacggagguggcagccaucuccuucucggcaucaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6400 - RNA, 2473 nt, Artificial Sequence
  ZIKV prME variant mRNA Design 2 opt
ggggcgcugccuacggagguggcagccaucuccuucucggcaucaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6401 - RNA, 2470 nt, Artificial Sequence
  ZIKV prME variant mRNA Design 2 opt
ggggcgcugccuacggagguggcagccaucuccuucucggcaucaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6402 - RNA, 2467 nt, Artificial Sequence
  ZIKV prME variant mRNA Design 2 opt
ggggcgcugccuacggagguggcagccaucuccuucucggcaucaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6403 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6404 - RNA, 2461 nt, Artificial Sequence
  ZIKV prME variant mRNA Design 2 opt
ggggcgcugccuacggagguggcagccaucuccuucucggcaucaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6405 - RNA, 2458 nt, Artificial Sequence
  ZIKV prME variant mRNA Design 2 opt
ggggcgcugccuacggagguggcagccaucuccuucucggcaucaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6406 - RNA, 2455 nt, Artificial Sequence
  ZIKV prME variant mRNA Design 2 opt
ggggcgcugccuacggagguggcagccaucuccuucucggcaucaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6407 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6408 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6409 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6410 - RNA, 2488 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6411 - RNA, 2488 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6412 - RNA, 2494 nt, Artificial Sequence
  ZIKV prME variant mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6413 - RNA, 2488 nt, Artificial Sequence
  ZIKV prME variant mRNA Design 2 opt
ggggcgcugccuacggagguggcagccaucuccuucucggcaucaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6414 - RNA, 2491 nt, Artificial Sequence
  ZIKV prME variant mRNA Design 2 opt
ggggcgcugccuacggagguggcagccaucuccuucucggcaucaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6415 - RNA, 2485 nt, Artificial Sequence
  ZIKV prME variant mRNA Design 2 opt
ggggcgcugccuacggagguggcagccaucuccuucucggcaucaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6416 - RNA, 2482 nt, Artificial Sequence
  ZIKV prME variant mRNA Design 2 opt
ggggcgcugccuacggagguggcagccaucuccuucucggcaucaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6417 - RNA, 2479 nt, Artificial Sequence
  ZIKV prME variant mRNA Design 2 opt
ggggcgcugccuacggagguggcagccaucuccuucucggcaucaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6418 - RNA, 2476 nt, Artificial Sequence
  ZIKV prME variant mRNA Design 2 opt
ggggcgcugccuacggagguggcagccaucuccuucucggcaucaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6419 - RNA, 2473 nt, Artificial Sequence
  ZIKV prME variant mRNA Design 2 opt
ggggcgcugccuacggagguggcagccaucuccuucucggcaucaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6420 - RNA, 2470 nt, Artificial Sequence
  ZIKV prME variant mRNA Design 2 opt
ggggcgcugccuacggagguggcagccaucuccuucucggcaucaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6421 - RNA, 2467 nt, Artificial Sequence
  ZIKV prME variant mRNA Design 2 opt
ggggcgcugccuacggagguggcagccaucuccuucucggcaucaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6422 - RNA, 2464 nt, Artificial Sequence
  ZIKV prME variant mRNA Design 2 opt
ggggcgcugccuacggagguggcagccaucuccuucucggcaucaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6423 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6424 - RNA, 2458 nt, Artificial Sequence
  ZIKV prME variant mRNA Design 2 opt
ggggcgcugccuacggagguggcagccaucuccuucucggcaucaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6425 - RNA, 2455 nt, Artificial Sequence
  ZIKV prME variant mRNA Design 2 opt
ggggcgcugccuacggagguggcagccaucuccuucucggcaucaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6426 - RNA, 2452 nt, Artificial Sequence
  ZIKV prME variant mRNA Design 2 opt
ggggcgcugccuacggagguggcagccaucuccuucucggcaucaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6427 - RNA, 2449 nt, Artificial Sequence; identical to SEQ ID NO: 6333
  ZIKV (strain ZikaSPH2015) Polyprotein(108-794) mRNA Design 2 opt

SEQ ID NO: 6428 - RNA, 2449 nt, Artificial Sequence
  ZIKV prME variant mRNA Design 2 opt
ggggcgcugccuacggagguggcagccaucuccuucucggcaucaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6429 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6430 - RNA, 2485 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6431 - RNA, 2485 nt, Artificial Sequence
  ZIKV prME variant mRNA Design 2 opt
ggggcgcugccuacggagguggcagccaucuccuucucggcaucaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6432 - RNA, 2524 nt, Artificial Sequence; identical to SEQ ID NO: 6329
  KU321639.1 prME-long mRNA Design 2 opt

SEQ ID NO: 6433 - RNA, 2524 nt, Artificial Sequence; identical to SEQ ID NO: 6330
  KU312312.1 prME-long mRNA Design 2 opt

SEQ ID NO: 6434 - RNA, 2512 nt, Artificial Sequence; identical to SEQ ID NO: 6331
  AY632535.2 prME-long mRNA Design 2 opt

SEQ ID NO: 6435 - RNA, 2524 nt, Artificial Sequence; identical to SEQ ID NO: 6332
  KU527068.1 prME-long mRNA Design 2 opt

SEQ ID NO: 6436 - RNA, 2524 nt, Artificial Sequence
  KU720415.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6437 - RNA, 2506 nt, Artificial Sequence
  DQ859059.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6438 - RNA, 2524 nt, Artificial Sequence
  KX377335.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6439 - RNA, 2524 nt, Artificial Sequence
  LC002520.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6440 - RNA, 2512 nt, Artificial Sequence
  KU963573.2 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6441 - RNA, 2524 nt, Artificial Sequence
  KX694534.2 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6442 - RNA, 2524 nt, Artificial Sequence
  KX447520.1 prME-long mRNA Design 2 opt
ggggcgcugccuacggagguggcagccaucuccuucucggcaucaagcuuaccaugagaaucaucaacgccagaaaggagaagaagagaagaggcgccgacgccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6443 - RNA, 2524 nt, Artificial Sequence
  KX369547.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6444 - RNA, 2524 nt, Artificial Sequence
  KX447515.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6445 - RNA, 2524 nt, Artificial Sequence
  KU501217.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6446 - RNA, 2524 nt, Artificial Sequence
  KU312314.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6447 - RNA, 2524 nt, Artificial Sequence
  KX446950.2 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6448 - RNA, 2524 nt, Artificial Sequence
  KY003157.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6449 - RNA, 2524 nt, Artificial Sequence
  KX811222.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6450 - RNA, 2524 nt, Artificial Sequence
  KX447516.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6451 - RNA, 2524 nt, Artificial Sequence
  KX520666.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6452 - RNA, 2524 nt, Artificial Sequence
  KU729218.1 prME-long mRNA Design 2 opt
ggggcgcugccuacggagguggcagccaucuccuucucggcaucaagcuuaccaugagaaucaucaacgccagaaaggagaagaagagaagaagcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6453 - RNA, 2524 nt, Artificial Sequence
  KU761561.1 prME-long mRNA Design 2 opt
ggggcgcugccuacggagguggcagccaucuccuucucggcaucaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6454 - RNA, 2524 nt, Artificial Sequence
  KY317938.1 prME-long mRNA Design 2 opt
ggggcgcugccuacggagguggcagccaucuccuucucggcaucaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6455 - RNA, 2524 nt, Artificial Sequence
  KY075939.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6456 - RNA, 2524 nt, Artificial Sequence
  KX806557.2 prME-long mRNA Design 2 opt
ggggcgcugccuacggagguggcagccaucuccuucucggcaucaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6457 - RNA, 2524 nt, Artificial Sequence
  KU870645.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6458 - RNA, 2524 nt, Artificial Sequence
  KU729217.2 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6459 - RNA, 2524 nt, Artificial Sequence
  KU497555.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6460 - RNA, 2524 nt, Artificial Sequence
  KX087101.3 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6461 - RNA, 2524 nt, Artificial Sequence
  KY075932.1 prME-long mRNA Design 2 opt
ggggcgcugccuacggagguggcagccaucuccuucucggcaucaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6462 - RNA, 2524 nt, Artificial Sequence
  KY014317.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6463 - RNA, 2524 nt, Artificial Sequence
  KU758876.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6464 - RNA, 2524 nt, Artificial Sequence
  KU758874.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6465 - RNA, 2524 nt, Artificial Sequence
  KY014314.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6466 - RNA, 2524 nt, Artificial Sequence
  KU926310.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6467 - RNA, 2524 nt, Artificial Sequence
  KU761560.1 prME-long mRNA Design 2 opt
ggggcgcugccuacggagguggcagccaucuccuucucggcaucaagcuuaccaugagaaucaucaacgccggcaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6468 - RNA, 2524 nt, Artificial Sequence
  KY317939.1 prME-long mRNA Design 2 opt
ggggcgcugccuacggagguggcagccaucuccuucucggcaucaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6469 - RNA, 2524 nt, Artificial Sequence
  KY075937.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6470 - RNA, 2524 nt, Artificial Sequence
  LC191864.1 prME-long mRNA Design 2 opt
ggggcgcugccuacggagguggcagccaucuccuucucggcaucaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6471 - RNA, 2524 nt, Artificial Sequence
  KX447517.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6472 - RNA, 2524 nt, Artificial Sequence
  KU922923.1 prME-long mRNA Design 2 opt
ggggcgcugccuacggagguggcagccaucuccuucucggcaucaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6473 - RNA, 2524 nt, Artificial Sequence
  KY003156.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6474 - RNA, 2524 nt, Artificial Sequence
  KU312313.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6475 - RNA, 2524 nt, Artificial Sequence
  KY075935.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6476 - RNA, 2524 nt, Artificial Sequence
  KY014320.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6477 - RNA, 2524 nt, Artificial Sequence
  KX827309.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6478 - RNA, 2524 nt, Artificial Sequence
  KU681081.3 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6479 - RNA, 2524 nt, Artificial Sequence
  KU744693.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcggcgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6480 - RNA, 2524 nt, Artificial Sequence
  KY328290.1 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6481 - RNA, 2524 nt, Artificial Sequence
  KX694532.2 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6482 - RNA, 2524 nt, Artificial Sequence
  KU955593.1 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6483 - RNA, 2524 nt, Artificial Sequence
  KY272987.1 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6484 - RNA, 2524 nt, Artificial Sequence
  EU545988.1 prME-long mRNA Design 2 opt
ggggcgcugccuacggagguggcagccaucuccuucucggcaucaagcuuaccaugagaaucaucaacgccagaaaggagaagaagagaagaggcaccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6485 - RNA, 2524 nt, Artificial Sequence
  KU681082.3 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6486 - RNA, 2524 nt, Artificial Sequence
  KX601167.1 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6487 - RNA, 2524 nt, Artificial Sequence
  KX694533.2 prME-long mRNA Design 2 opt
ggggcgcugccuacggagguggcagccaucuccuucucggcaucaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6488 - RNA, 2524 nt, Artificial Sequence
  KY288905.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6489 - RNA, 2524 nt, Artificial Sequence
  KF268950.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6490 - RNA, 2524 nt, Artificial Sequence
  KF383121.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6491 - RNA, 2506 nt, Artificial Sequence
  KF268949.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6492 - RNA, 2524 nt, Artificial Sequence
  KU955595.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6493 - RNA, 2524 nt, Artificial Sequence
  KF383116.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6494 - RNA, 2506 nt, Artificial Sequence
  KU963574.2 prME-long mRNA Design 2 opt
ggggcgcugccuacggagguggcagccaucuccuucucggcaucaagcuuaccaugagaaucaucaacgccagaaaggagagaaagagaagaggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6495 - RNA, 2506 nt, Artificial Sequence
  KX601166.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6496 - RNA, 2524 nt, Artificial Sequence
  KF383118.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6497 - RNA, 2518 nt, Artificial Sequence
  KF383120.1 prME-long mRNA Design 2 opt
ggggcgcugccuacggagguggcagccaucuccuucucggcaucaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccgacgugggcugcagcguggacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6498 - RNA, 2449 nt, Artificial Sequence; identical to SEQ ID NO: 6333
  KU321639.1 prME-short mRNA Design 2 opt

SEQ ID NO: 6499 - RNA, 2449 nt, Artificial Sequence; identical to SEQ ID NO: 6334
  KU312312.1 prME-short mRNA Design 2 opt

SEQ ID NO: 6500 - RNA, 2437 nt, Artificial Sequence; identical to SEQ ID NO: 6335
  AY632535.2 prME-short mRNA Design 2 opt

SEQ ID NO: 6501 - RNA, 2449 nt, Artificial Sequence; identical to SEQ ID NO: 6336
  KU527068.1 prME-short mRNA Design 2 opt

SEQ ID NO: 6502 - RNA, 2449 nt, Artificial Sequence
  KX421193.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6503 - RNA, 2449 nt, Artificial Sequence
  KX377335.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6504 - RNA, 2449 nt, Artificial Sequence
  LC002520.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6505 - RNA, 2431 nt, Artificial Sequence
  DQ859059.1 prME-short mRNA Design 2 opt
ggggcgcugccuacggagguggcagccaucuccuucucggcaucaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6506 - RNA, 2437 nt, Artificial Sequence
  KU963573.2 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6507 - RNA, 2449 nt, Artificial Sequence
  KX694534.2 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6508 - RNA, 2449 nt, Artificial Sequence
  KX369547.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6509 - RNA, 2449 nt, Artificial Sequence
  KX447515.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6510 - RNA, 2449 nt, Artificial Sequence
  KU729218.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6511 - RNA, 2449 nt, Artificial Sequence
  KU501217.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6512 - RNA, 2449 nt, Artificial Sequence
  KU312314.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6513 - RNA, 2449 nt, Artificial Sequence
  KX446950.2 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6514 - RNA, 2449 nt, Artificial Sequence
  KY003157.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6515 - RNA, 2449 nt, Artificial Sequence
  KX811222.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6516 - RNA, 2449 nt, Artificial Sequence
  KX447516.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6517 - RNA, 2449 nt, Artificial Sequence
  KX520666.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6518 - RNA, 2449 nt, Artificial Sequence
  KU497555.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6519 - RNA, 2449 nt, Artificial Sequence
  KY075939.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6520 - RNA, 2449 nt, Artificial Sequence
  KY075932.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6521 - RNA, 2449 nt, Artificial Sequence
  KU870645.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6522 - RNA, 2449 nt, Artificial Sequence
  KU729217.2 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6523 - RNA, 2449 nt, Artificial Sequence
  KX087101.3 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6524 - RNA, 2449 nt, Artificial Sequence
  KY014317.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6525 - RNA, 2449 nt, Artificial Sequence
  KU758876.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6526 - RNA, 2449 nt, Artificial Sequence
  KU758874.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6527 - RNA, 2449 nt, Artificial Sequence
  KY317939.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6528 - RNA, 2449 nt, Artificial Sequence
  KY014314.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6529 - RNA, 2449 nt, Artificial Sequence
  KX447517.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6530 - RNA, 2449 nt, Artificial Sequence
  KU926310.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6531 - RNA, 2449 nt, Artificial Sequence
  KU922923.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6532 - RNA, 2449 nt, Artificial Sequence
  KY075937.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6533 - RNA, 2449 nt, Artificial Sequence
  KY003156.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6534 - RNA, 2449 nt, Artificial Sequence
  KU312313.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6535 - RNA, 2449 nt, Artificial Sequence
  KY075935.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6536 - RNA, 2449 nt, Artificial Sequence
  KY014320.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6537 - RNA, 2449 nt, Artificial Sequence
  KY328290.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6538 - RNA, 2449 nt, Artificial Sequence
  KU681081.3 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6539 - RNA, 2449 nt, Artificial Sequence
  KX827309.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6540 - RNA, 2449 nt, Artificial Sequence
  KU955593.1 prME-short mRNA Design 2 opt
ggggcgcugccuacggagguggcagccaucuccuucucggcaucaagcuuaccaugaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6541 - RNA, 2449 nt, Artificial Sequence
  KY272987.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6542 - RNA, 2449 nt, Artificial Sequence
  KY007221.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6543 - RNA, 2449 nt, Artificial Sequence
  EU545988.1 prME-short mRNA Design 2 opt
ggggcgcugccuacggagguggcagccaucuccuucucggcaucaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6544 - RNA, 2449 nt, Artificial Sequence
  KU681082.3 prME-short mRNA Design 2 opt
ggggcgcugccuacggagguggcagccaucuccuucucggcaucaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6545 - RNA, 2449 nt, Artificial Sequence
  KX601167.1 prME-short mRNA Design 2 opt
ggggcgcugccuacggagguggcagccaucuccuucucggcaucaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6546 - RNA, 2449 nt, Artificial Sequence
  KX694533.2 prME-short mRNA Design 2 opt
ggggcgcugccuacggagguggcagccaucuccuucucggcaucaagcuuaccaugaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6547 - RNA, 2449 nt, Artificial Sequence
  KY288905.1 prME-short mRNA Design 2 opt
ggggcgcugccuacggagguggcagccaucuccuucucggcaucaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6548 - RNA, 2449 nt, Artificial Sequence
  KF268950.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6549 - RNA, 2449 nt, Artificial Sequence
  KF383121.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6550 - RNA, 2431 nt, Artificial Sequence
  KF268949.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6551 - RNA, 2449 nt, Artificial Sequence
  KU955595.1 prME-short mRNA Design 2 opt
ggggcgcugccuacggagguggcagccaucuccuucucggcaucaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6552 - RNA, 2449 nt, Artificial Sequence
  KF383116.1 prME-short mRNA Design 2 opt
ggggcgcugccuacggagguggcagccaucuccuucucggcaucaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6553 - RNA, 2431 nt, Artificial Sequence
  KX601166.1 prME-short mRNA Design 2 opt
ggggcgcugccuacggagguggcagccaucuccuucucggcaucaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6554 - RNA, 2449 nt, Artificial Sequence
  KF383118.1 prME-short mRNA Design 2 opt
ggggcgcugccuacggagguggcagccaucuccuucucggcaucaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6555 - RNA, 2446 nt, Artificial Sequence
  KX447520.1 prME-short mRNA Design 2 opt
ggggcgcugccuacggagguggcagccaucuccuucucggcaucaagcuuaccaugagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6556 - RNA, 2449 nt, Artificial Sequence
  KU761561.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6557 - RNA, 2449 nt, Artificial Sequence
  KX806557.2 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6558 - RNA, 2449 nt, Artificial Sequence
  LC191864.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6559 - RNA, 2449 nt, Artificial Sequence
  KU744693.1 prME-short mRNA Design 2 opt
ggggcgcugccuacggagguggcagccaucuccuucucggcaucaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6560 - RNA, 2440 nt, Artificial Sequence
  KU963574.2 prME-short mRNA Design 2 opt
ggggcgcugccuacggagguggcagccaucuccuucucggcaucaagcuuaccaugggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6561 - RNA, 2458 nt, Artificial Sequence
  KF383120.1 prME-short mRNA Design 2 opt
ggggcgcugccuacggagguggcagccaucuccuucucggcaucaagcuuaccaugggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6562 - RNA, 1741 nt, Artificial Sequence; identical to SEQ ID NO: 6337
  KU321639.1 solE mRNA Design 2 opt

SEQ ID NO: 6563 - RNA, 1741 nt, Artificial Sequence; identical to SEQ ID NO: 6338
  KU312312.1 solE mRNA Design 2 opt

SEQ ID NO: 6564 - RNA, 1729 nt, Artificial Sequence; identical to SEQ ID NO: 6339
  AY632535.2 solE mRNA Design 2 opt

SEQ ID NO: 6565 - RNA, 1741 nt, Artificial Sequence; identical to SEQ ID NO: 6338
  KU527068.1 solE mRNA Design 2 opt

SEQ ID NO: 6566 - RNA, 1741 nt, Artificial Sequence
  KX421193.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6567 - RNA, 1741 nt, Artificial Sequence
  LC002520.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6568 - RNA, 1723 nt, Artificial Sequence
  DQ859059.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6569 - RNA, 1729 nt, Artificial Sequence
  KU963573.2 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6570 - RNA, 1741 nt, Artificial Sequence
  KY075939.1 solE mRNA Design 2 opt
ggggcgcugccuacggagguggcagccaucuccuucucggcaucaagcuuaccaugagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6571 - RNA, 1741 nt, Artificial Sequence
  KX447516.1 solE mRNA Design 2 opt
ggggcgcugccuacggagguggcagccaucuccuucucggcaucaagcuuaccaugagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6572 - RNA, 1741 nt, Artificial Sequence
  KX447515.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6573 - RNA, 1741 nt, Artificial Sequence
  KU758874.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6574 - RNA, 1741 nt, Artificial Sequence
  KU729218.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6575 - RNA, 1741 nt, Artificial Sequence
  KU501217.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6576 - RNA, 1741 nt, Artificial Sequence
  KU761561.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6577 - RNA, 1741 nt, Artificial Sequence
  KY075937.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6578 - RNA, 1741 nt, Artificial Sequence
  KY014317.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6579 - RNA, 1741 nt, Artificial Sequence
  KU870645.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6580 - RNA, 1741 nt, Artificial Sequence
  KU922923.1 solE mRNA Design 2 opt
ggggcgcugccuacggagguggcagccaucuccuucucggcaucaagcuuaccaugagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6581 - RNA, 1741 nt, Artificial Sequence
  KU497555.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6582 - RNA, 1741 nt, Artificial Sequence
  KU312314.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6583 - RNA, 1741 nt, Artificial Sequence
  KY014314.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6584 - RNA, 1741 nt, Artificial Sequence
  KX447517.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6585 - RNA, 1741 nt, Artificial Sequence
  KU729217.2 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6586 - RNA, 1741 nt, Artificial Sequence
  KY328290.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6587 - RNA, 1741 nt, Artificial Sequence
  KX087101.3 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6588 - RNA, 1741 nt, Artificial Sequence
  KY003156.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6589 - RNA, 1741 nt, Artificial Sequence
  KU758876.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6590 - RNA, 1741 nt, Artificial Sequence
  KU926310.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6591 - RNA, 1741 nt, Artificial Sequence
  KU681081.3 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6592 - RNA, 1741 nt, Artificial Sequence
  KU744693.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6593 - RNA, 1741 nt, Artificial Sequence
  EU545988.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6594 - RNA, 1741 nt, Artificial Sequence
  KY007221.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6595 - RNA, 1741 nt, Artificial Sequence
  KY003152.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcgccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6596 - RNA, 1741 nt, Artificial Sequence
  KX694533.2 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6597 - RNA, 1741 nt, Artificial Sequence
  KX601167.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6598 - RNA, 1741 nt, Artificial Sequence
  KY288905.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6599 - RNA, 1741 nt, Artificial Sequence
  KF268950.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6600 - RNA, 1741 nt, Artificial Sequence
  KF383116.1 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6601 - RNA, 1723 nt, Artificial Sequence
  KU963574.2 solE mRNA Design 2 opt
ggggcgcugccuacggagguggcagccaucuccuucucggcaucaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6602 - RNA, 1741 nt, Artificial Sequence
  KF383118.1 solE mRNA Design 2 opt
ggggcgcugccuacggagguggcagccaucuccuucucggcaucaagcuuaccaugagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6603 - RNA, 1741 nt, Artificial Sequence
  KX520666.1 solE mRNA Design 2 opt
ggggcgcugccuacggagguggcagccaucuccuucucggcaucaagcuuaccaugagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6604 - RNA, 1741 nt, Artificial Sequence
  KF383120.1 solE mRNA Design 2 opt
ggggcgcugccuacggagguggcagccaucuccuucucggcaucaagcuuaccaugagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6605 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6606 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaaugccaagaacgggagcaucucccugaugugucuugcucugggaggcguucucauuuuccugagcaccgccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6607 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugaggacagagcuaagguggaggucacaccuaauagcccgcgcgcggaagccacccuuggcggcuucgggucccugggacucgauugugagccccggaccggccuggacuuuucugaucuuuauuaccugacaaugaacaauaaacacuggcucgugcauaaggaaugguuccacgacauuccucugcccuggcacgcuggggccgauaccggaacaccucauuggaacaauaaagaggcccuggucgaauuuaaggacgcucacgccaagagacagacggugguugugcucggcagccaggagggggcgguccauaccgcucuggccggcgcccuugaggcugaaauggauggagccaaaggccgccuguucuccgggcaccucaagugccggcugaaaauggacaaacuuagacugaagggagugagcuauucucucuguacagcugccuuuaccuucacaaagguucccgcggagacccugcauggcacggugaccgucgaagugcaguacgccgggacagacggaccgugcaagaucccugugcaaauggcuguugauaugcagacccugacacccgucggccgccucaucaccgccaacccugugauuacggaguccacagaaaauagcaaaaugaugcuggagcuugacccucccuuuggggauucuuacaucgugauuggcgucggagacaagaaaaucacccaccacuggcaucgguccggcagcacaauugggaaggcuuucgaggccaccgugagaggagcgaaacgcauggccguucugggcgauaccgcuugggacuucggguccgugggaggcgucuuuaacucucucgggaagggcauccaccagaucuucggagccgcuuuuaagagccuguucggcgggauguccugguuuucucaaauucugaucggaacacuucucguguggcugggccugaacacgaaaaaugggagcauuucccucaccugucuggcccuuggaggcguuaugaucuuccugagcacagccgugucugcugaugucgggugcuccguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6608 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6609 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6610 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacgcuaagaauggcagcaucucccugaugugucuugcgcuugggggagugcucauuuuccugagcaccgccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6611 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacaauuggcaaggcuuucgaggccaccgugcgcggggcuaaacggauggccguucugggagacaccgcgugggauuucggcuccgucgggggaguguuuaauucucucggcaaggggauccaccagauuuucggcgccgcuuuuaaaagccuguucggaggcauguccugguuuucucaaauccugaucgggacacuucucguguggcugggacugaacacgaagaacggcagcauuucccucaccugucuggcccuugggggaguuaugaucuuccugagcacagcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6612 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6613 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggauauuguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6614 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgaaacgcauggcuguucucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6615 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugaggaccgggccaagguugaagugaccccuaacagcccccgcgcugaggccacacucgggggauuuggcucucugggccuggauugcgagccuagaaccgggcuugacuucuccgaucuguacuaccucacgaugaauaacaaacauuggcuggugcacaaggaaugguuucaugacauuccccuuccuuggcacgcgggagccgacacaggcaccccgcacuggaauaacaaagaggcucuggucgaguucaaggaugcccaugcuaagcggcagacagugguugugcucgggagccaggaaggagccguccacaccgcgcuggccggcgcucuggaagccgagauggacggggcuaaaggacgccucuuuuccggccaucugaaguguagacuuaaaauggauaagcugcggcucaaaggcgugucuuauagccugugcaccgccgccuucacauuuacgaagguucccgcugagacccuucacgggacagugaccgucgaagugcaauacgcgggaacagacggcccuuguaaaauccccguccagauggccguggauaugcagacccugacgccuguugggcgccucauuacagcuaaucccgugaucaccgaguccaccgaaaacagcaagaugaugcuggagcuggacccgccuuucggagauucuuauauugucaucggcgugggggacaagaaaaucacacaccauuggcacagauccggcagcaccauuggaaaggccuuugaagccacaguucggggcgcuaaacgcauggccgugcucggggauacggcgugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6616 - RNA, 1741 nt, Artificial Sequence; identical to SEQ ID NO: 6614
  ZIKV (strain NatalRGN) Polyprotein(273-723) mRNA Design 2 opt

SEQ ID NO: 6617 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagccucuauuuccgacauggcuagcgauuccagaugucccacgcaaggggaggcuuaccuggacaagcagucugacacccaguaugugugcaaacggacacucguugaucgcggauggggcaauggcugugggcugagcggaaagggcucccuggugaccugcgccaaauucgccugcagcaagaaaaugacagggaagucuauccagccugaaaaccucgaguacagaaucaugcuguccguccacggaagccaacacucuggcaugauugugaaugacaccgggcaugaaacggaugagaaccgggcuaagguugagaucacaccgaauagccccagagcggaagccacccuuggaggcuuuggcucccuggggcucgacugugagccucgcaccggacuggauuucucugaccuuuauuaccugacaaugaacaauaaacacuggcucgugcauaaggaaugguuucacgauauuccccugccuuggcacgcuggcgccgacaccgggacaccccauuggaacaauaaagaggcccuggucgaguucaaggaugcucacgccaaacggcagacgguggucgugcucggaagccaggaaggcgcgguucauaccgcucuggccggggcccuugaggcugaaauggacggcgccaagggaagacuguccagcggccaccucaaaugccgccugaagauggauaagcugcggcugaaaggggugucuuauucccucuguacagcugccuuuaccuucacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggagagcacagaaaacucuaagaugaugcuggagcuugaucccccuuuuggcgacuccuacaucguuauuggggucggcgagaaaaagaucacccaccacuggcaucgcagcggauccacaauuggcaaggccuucgaagcgaccgugagaggggccaaacggauggcugugcugggagauaccgccugggacuuuggcucugucgggggagcucucaauagccugggcaaggggauccaccagauuuucggcgccgccuucaaaucccuguuuggaggcaugucuugguucagccaaauccuuaucgggacacuccugauguggcugggacucaacacgaagaauggcuccauuagccugaugugucuugcucuugggggagugcucaucuuucugucuaccgcgguuuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6618 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagccucuaucuccgacauggcuagcgauuccagaugucccacccaaggggaggcuuaccuggacaagcagucugacacacaguauguuugcaaacggacccucguggaucgcggauggggcaauggcugugggcugagcggaaagggcucccuggucacaugcgccaaauucgccugcagcaagaaaaugaccgggaagucuauucagccugaaaaccucgaguacagaaucaugcuguccgugcacggaagccaacacucuggcaugaucguuaaugacacggggcaugaaacagaugagaaccgggcuaagguggagauuaccccgaauagccccagagcggaagccacccuuggaggcuuuggcucccuggggcucgacugugagccucgcacaggacuggauuucucugaccuuuauuaccugaccaugaacaauaaacacuggcucguccauaaggaaugguuucacgauaucccccugccuuggcacgcuggcgccgacacagggacgccccauuggaacaauaaagaggcccugguggaguucaaggaugcucacgccaaacggcagaccgucgugguucucggaagccaggaaggcgcggugcauacagcucuggccggggcccuugaggcugaaauggacggcgccaagggaagacuguccagcggccaccucaaaugccgccugaagauggauaagcugcggcugaaaggggucucuuauucccucuguaccgcugccuuuacauucaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagagcaccgaaaacucuaagaugaugcuggagcuugaucccccuuuuggcgacuccuacaucgucaucggggugggcgagaaaaagauuacacaccacuggcaucgcagcggauccaccaucggcaaggccuucgaagcgaccgugagaggggccaaacggauggcuguccugggagauacagccugggacuuuggcucuguugggggagcucucaauagccugggcaaggggauucaccagaucuucggcgccgccuucaaaucccuguuuggaggcaugucuugguucagccaaauucuuaucgggacgcuccugauguggcugggacucaacgcuaagaauggcuccaucagccugaugugucuugcgcuugggggagugcucauuuuucugucuaccgccguguccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6619 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguccggaaagggcagccuggugaccugcgcuaaauucacaugcucuaagaagaugaccgggaaauccauccagcccgagaaucucgaauaucgcauuaugcugagcguucacggaucucaacauagcggcaugaucggguacgagacggacgaagauagagccaagguggaggucacaccuaacuccccgcgggccgaggcuacccuuggaggcuuuggcucucuggggcucgacugugaacccagaaccggacuggauuucagcgaccuuuauuaccugacaaugaauaacaaacacuggcucgugcauaaggagugguuucacgauauuccucugcccuggcacgcgggcgccgacaccgggacaccucauuggaauaacaaagaagcucuggucgaguucaaggaugcccacgccaaacgccagacggugguugugcucggaucccaggaaggcgcuguccauaccgcccuggcgggggcucuugaggccgagauggacggcgccaagggacggcuguuuagcggccaccucaagugcagacugaaaauggauaaacuucgccugaagggggugucuuauucccucuguacagcugccuucaccuuuacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaaagcacagagaacucuaagaugaugcuggaacuugauccucccuucggcgacuccuacaucgugauuggggucggcgauaagaaaaucacccaccacuggcauagaagcggauccacaauuggcaaggcuuuugaggccaccgugcgcggggcuaaacggauggccguucugggagacaccgcgugggauuucggcucugucgggggaguguucaauagccucggcaaggggauccaccagauuuuuggcgccgcuuucaaaucccuguuuggaggcaugucuugguucagccaaauccugaucgggacacuucucguguggcugggacugaacacgaagaacggcuccauuagccucaccugucuggcccuugggggaguuaugaucuuucugucuacagcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6620 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcugagcggaaagggcucccuggugaccugcgccaaauucgccugcagcaagaaaaugacagggaagucuauucagccugaaaaccucgaguacagaaucaugcuguccgugcacggaagccaacacucuggcaugaucguuaaugacaccgggcaugaaacggaugagaaccgggcuaagguggagauuacaccgaauagccccagagcggaagccacccuuggaggcuuuggcucccuggggcucgacugugagccucgcaccggacuggauuucucugaccuuuauuaccugacaaugaacaauaaacacuggcucguccauaaggaaugguuucacgauaucccccugccuuggcacgcuggcgccgacaccgggacaccccauuggaacaauaaagaggcccugguggaguucaaggaugcucacgccaaacggcagacggucgugguucucggaagccaggaaggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuuuaccuucacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggagagcacagaaaacucuaagaugaugcuggagcuugaucccccuuuuggcgacuccuacaucgucaucggggugggcgagaaaaagauuacccaccacuggcaucgcagcggauccacaaucggcaaggccuucgaagcgaccgugagaggggccaaacggauggcuguccugggagauaccgccugggacuuuggcucugucgggggagcucucaauagccugggcaaggggauucaccagaucuucggcgccgccuucaaaucccuguuuggaggcaugucuugguucagccaaauucuuaucgggacacuccugauguggcugggacucaacacgaagaauggcuccaucagccugaugugucuugcucuugggggaguucucauuuuucugucuaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6621 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugcaggacaccgggcaugaaacggaugagaaucgggcuaagguugagaucacaccgaacucucccagagcggaagccacccuuggaggcuucggcagccuggggcucgacugugagccucgcaccggacuggauuuuuccgaccuuuauuaccugacaaugaauaacaaacacuggcucgugcauaaggaaugguuccacgauauuccccugccuuggcacgcuggcgccgacaccgggacaccccauuggaauaacaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaauacgccggcacagacgggccuugcaaagugcccgcucagauggccgucgacaugcagacccugacaccugugggaagacucauuaccgcuaaucccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaacucucugggcaaggggauccaccaaauuuucggcgccgccuuuaaaagccuguucggaggcauguccugguuuucucagauccuuaucgggacacuccugauguggcugggacucaauacgaagaacggcagcauuucccugaugugucuugcucuugggggagugcucaucuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6622 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguucaggacacggggcaugaaacagaugagaaucgggcuaagguggagauuaccccgaacucucccagagcggaagccacccuuggaggcuucggcagccuggggcucgacugugagccucgcacaggacuggauuuuuccgaccuuuauuaccugaccaugaauaacaaacacuggcucguccauaaggaaugguuccacgauaucccccugccuuggcacgcuggcgccgacacagggacgccccauuggaauaacaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaauacgccggcaccgacgggccuugcaaaguccccgcucagauggccguggacaugcagacacugaccccugugggaagacucaucacggcuaaucccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaacucucugggcaaggggauucaccaaaucuucggcgccgccuuuaaaagccuguucggaggcauguccugguuuucucagauucuuaucgggacgcuccugauguggcugggacucaaugcuaagaacggcagcaucucccugaugugucuugcgcuugggggagugcucauuuuccugagcaccgccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6623 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguucaggacaccgggcaugaaacggaugagaaucgggcuaagguggagauuacaccgaacucucccagagcggaagccacccuuggaggcuucggcagccuggggcucgacugugagccucgcaccggacuggauuuuuccgaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggaagacucaucaccgcuaaucccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaacucucugggcaaggggauucaccaaaucuucggcgccgccuuuaaaagccuguucggaggcauguccugguuuucucagauucuuaucgggacacuccugauguggcugggacucaauacgaagaacggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6624 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaaacuucggcugaagggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacacugggcaaggccuuuuccaccacccucaaaggggcgcagcggcuggccgcucugggagauacagccugggacuucggcucuauugggggaguguucaauagcaucggcagagcugugcaccaagucuuugggggcgccuuccgcacgcuuuuuggaggcauguccuggauuacccaggggcucaugggagcccugcugcucuggaugggcgugaacgcucgggauagaucuaucgcgcuggccuuccuugcuacagggggaguucugguguuucucgccaccaauguccaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6625 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaaacuucggcugaagggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcacccugggcaaggccuuuuccaccacacucaaaggggcgcagcggcuggccgcucugggagauacggccugggacuucggcucuaucgggggaguguucaauagcauuggcagagcuguccaccaaguguuugggggcgccuuccgcacccuuuuuggaggcauguccuggaucacacaggggcucaugggagcccugcugcucuggaugggcguuaacgcucgggauagaucuauugcgcuggccuuccuugcuaccgggggagugcuggucuuucucgccacaaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6626 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacacugggcaaggcuuucuccaccacccucaaaggggcccagcgccuggcugcccugggagacacagcgugggauuucggcucuauugggggaguguuuaauagcaucggccgggccguucaccaaguguucgggggcgcuuuuagaacgcuuuucggaggcauguccuggauuacccaggggcucaugggagcccugcugcucuggaugggcgucaacgcucgcgaccggucuaucgcccuggccuuucuugcuacagggggagugcugguuuuccucgcgaccaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6627 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaaacuucggcugaagggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacacugggcaaggccuuuuccaccacccucaaaggggcgcagcggcuggccgcucugggagauacagccugggacuucggcucuaucgggggaguguucaauagcauuggcagagcuguccaccaaguguuugggggcgccuuccgcacgcuuuuuggaggcauguccuggaucacccaggggcucaugggagcccugcugcucuggaugggcguuaacgcucgggauagaucuauugcgcuggccuuccuugcuacagggggagugcuggucuuucucgccaccaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6628 - RNA, 2524 nt, Artificial Sequence; identical to SEQ ID NO: 6605
  ZIKV (strain ZikaSPH2015) Polyprotein(93-804) mRNA Design 2 opt

SEQ ID NO: 6629 - RNA, 2521 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6630 - RNA, 2518 nt, Artificial Sequence
  ZIKV prME variant mRNA Design 2 opt
ggggcgcugccuacggagguggcagccaucuccuucucggcaucaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6631 - RNA, 2515 nt, Artificial Sequence
  ZIKV prME variant mRNA Design 2 opt
ggggcgcugccuacggagguggcagccaucuccuucucggcaucaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6632 - RNA, 2512 nt, Artificial Sequence
  ZIKV prME variant mRNA Design 2 opt
ggggcgcugccuacggagguggcagccaucuccuucucggcaucaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6633 - RNA, 2509 nt, Artificial Sequence
  ZIKV prME variant mRNA Design 2 opt
ggggcgcugccuacggagguggcagccaucuccuucucggcaucaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6634 - RNA, 2506 nt, Artificial Sequence
  ZIKV prME variant mRNA Design 2 opt
ggggcgcugccuacggagguggcagccaucuccuucucggcaucaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6635 - RNA, 2503 nt, Artificial Sequence
  ZIKV prME variant mRNA Design 2 opt
ggggcgcugccuacggagguggcagccaucuccuucucggcaucaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6636 - RNA, 2500 nt, Artificial Sequence
  ZIKV prME variant mRNA Design 2 opt
ggggcgcugccuacggagguggcagccaucuccuucucggcaucaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6637 - RNA, 2497 nt, Artificial Sequence
  ZIKV prME variant mRNA Design 2 opt
ggggcgcugccuacggagguggcagccaucuccuucucggcaucaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcuccgucgauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6638 - RNA, 2494 nt, Artificial Sequence
  ZIKV prME variant mRNA Design 2 opt
ggggcgcugccuacggagguggcagccaucuccuucucggcaucaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6639 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6640 - RNA, 2488 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6641 - RNA, 2485 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6642 - RNA, 2482 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6643 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcuccgucgacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6644 - RNA, 2479 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcuccgucgacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6645 - RNA, 2491 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6646 - RNA, 2515 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcucugucgauuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6647 - RNA, 2515 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcucugucgauuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6648 - RNA, 2506 nt, Artificial Sequence
  ZIKV prME variant mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6649 - RNA, 2503 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6650 - RNA, 2500 nt, Artificial Sequence
  ZIKV prME variant mRNA Design 2 opt
ggggcgcugccuacggagguggcagccaucuccuucucggcaucaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6651 - RNA, 2497 nt, Artificial Sequence
  ZIKV prME variant mRNA Design 2 opt
ggggcgcugccuacggagguggcagccaucuccuucucggcaucaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6652 - RNA, 2494 nt, Artificial Sequence
  ZIKV prME variant mRNA Design 2 opt
ggggcgcugccuacggagguggcagccaucuccuucucggcaucaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6653 - RNA, 2491 nt, Artificial Sequence
  ZIKV prME variant mRNA Design 2 opt
ggggcgcugccuacggagguggcagccaucuccuucucggcaucaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6654 - RNA, 2488 nt, Artificial Sequence
  ZIKV prME variant mRNA Design 2 opt
ggggcgcugccuacggagguggcagccaucuccuucucggcaucaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6655 - RNA, 2485 nt, Artificial Sequence
  ZIKV prME variant mRNA Design 2 opt
ggggcgcugccuacggagguggcagccaucuccuucucggcaucaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6656 - RNA, 2482 nt, Artificial Sequence
  ZIKV prME variant mRNA Design 2 opt
ggggcgcugccuacggagguggcagccaucuccuucucggcaucaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6657 - RNA, 2479 nt, Artificial Sequence
  ZIKV prME variant mRNA Design 2 opt
ggggcgcugccuacggagguggcagccaucuccuucucggcaucaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6658 - RNA, 2476 nt, Artificial Sequence
  ZIKV prME variant mRNA Design 2 opt
ggggcgcugccuacggagguggcagccaucuccuucucggcaucaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6659 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6660 - RNA, 2470 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6661 - RNA, 2467 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6662 - RNA, 2464 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6663 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6664 - RNA, 2461 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6665 - RNA, 2473 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6666 - RNA, 2497 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6667 - RNA, 2497 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6668 - RNA, 2497 nt, Artificial Sequence
  ZIKV prME variant mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6669 - RNA, 2494 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6670 - RNA, 2491 nt, Artificial Sequence
  ZIKV prME variant mRNA Design 2 opt
ggggcgcugccuacggagguggcagccaucuccuucucggcaucaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6671 - RNA, 2488 nt, Artificial Sequence
  ZIKV prME variant mRNA Design 2 opt
ggggcgcugccuacggagguggcagccaucuccuucucggcaucaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6672 - RNA, 2485 nt, Artificial Sequence
  ZIKV prME variant mRNA Design 2 opt
ggggcgcugccuacggagguggcagccaucuccuucucggcaucaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6673 - RNA, 2482 nt, Artificial Sequence
  ZIKV prME variant mRNA Design 2 opt
ggggcgcugccuacggagguggcagccaucuccuucucggcaucaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6674 - RNA, 2479 nt, Artificial Sequence
  ZIKV prME variant mRNA Design 2 opt
ggggcgcugccuacggagguggcagccaucuccuucucggcaucaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6675 - RNA, 2476 nt, Artificial Sequence
  ZIKV prME variant mRNA Design 2 opt
ggggcgcugccuacggagguggcagccaucuccuucucggcaucaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6676 - RNA, 2473 nt, Artificial Sequence
  ZIKV prME variant mRNA Design 2 opt
ggggcgcugccuacggagguggcagccaucuccuucucggcaucaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6677 - RNA, 2470 nt, Artificial Sequence
  ZIKV prME variant mRNA Design 2 opt
ggggcgcugccuacggagguggcagccaucuccuucucggcaucaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6678 - RNA, 2467 nt, Artificial Sequence
  ZIKV prME variant mRNA Design 2 opt
ggggcgcugccuacggagguggcagccaucuccuucucggcaucaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6679 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6680 - RNA, 2461 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6681 - RNA, 2458 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6682 - RNA, 2455 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6683 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6684 - RNA, 2452 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6685 - RNA, 2464 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6686 - RNA, 2488 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6687 - RNA, 2488 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6688 - RNA, 2494 nt, Artificial Sequence
  ZIKV prME variant mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6689 - RNA, 2488 nt, Artificial Sequence
  ZIKV prME variant mRNA Design 2 opt
ggggcgcugccuacggagguggcagccaucuccuucucggcaucaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6690 - RNA, 2491 nt, Artificial Sequence
  ZIKV prME variant mRNA Design 2 opt
ggggcgcugccuacggagguggcagccaucuccuucucggcaucaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6691 - RNA, 2485 nt, Artificial Sequence
  ZIKV prME variant mRNA Design 2 opt
ggggcgcugccuacggagguggcagccaucuccuucucggcaucaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6692 - RNA, 2482 nt, Artificial Sequence
  ZIKV prME variant mRNA Design 2 opt
ggggcgcugccuacggagguggcagccaucuccuucucggcaucaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6693 - RNA, 2479 nt, Artificial Sequence
  ZIKV prME variant mRNA Design 2 opt
ggggcgcugccuacggagguggcagccaucuccuucucggcaucaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6694 - RNA, 2476 nt, Artificial Sequence
  ZIKV prME variant mRNA Design 2 opt
ggggcgcugccuacggagguggcagccaucuccuucucggcaucaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6695 - RNA, 2473 nt, Artificial Sequence
  ZIKV prME variant mRNA Design 2 opt
ggggcgcugccuacggagguggcagccaucuccuucucggcaucaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6696 - RNA, 2470 nt, Artificial Sequence
  ZIKV prME variant mRNA Design 2 opt
ggggcgcugccuacggagguggcagccaucuccuucucggcaucaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6697 - RNA, 2467 nt, Artificial Sequence
  ZIKV prME variant mRNA Design 2 opt
ggggcgcugccuacggagguggcagccaucuccuucucggcaucaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6698 - RNA, 2464 nt, Artificial Sequence
  ZIKV prME variant mRNA Design 2 opt
ggggcgcugccuacggagguggcagccaucuccuucucggcaucaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6699 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6700 - RNA, 2458 nt, Artificial Sequence
  ZIKV prME variant mRNA Design 2 opt
ggggcgcugccuacggagguggcagccaucuccuucucggcaucaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6701 - RNA, 2455 nt, Artificial Sequence
  ZIKV prME variant mRNA Design 2 opt
ggggcgcugccuacggagguggcagccaucuccuucucggcaucaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6702 - RNA, 2452 nt, Artificial Sequence
  ZIKV prME variant mRNA Design 2 opt
ggggcgcugccuacggagguggcagccaucuccuucucggcaucaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6703 - RNA, 2449 nt, Artificial Sequence; identical to SEQ ID NO: 6609
  ZIKV (strain ZikaSPH2015) Polyprotein(108-794) mRNA Design 2 opt

SEQ ID NO: 6704 - RNA, 2449 nt, Artificial Sequence
  ZIKV prME variant mRNA Design 2 opt
ggggcgcugccuacggagguggcagccaucuccuucucggcaucaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6705 - RNA, 2461 nt, Artificial Sequence
  ZIKV prME variant mRNA Design 2 opt
ggggcgcugccuacggagguggcagccaucuccuucucggcaucaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6706 - RNA, 2485 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6707 - RNA, 2485 nt, Artificial Sequence
  ZIKV prME variant mRNA Design 2 opt
ggggcgcugccuacggagguggcagccaucuccuucucggcaucaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6708 - RNA, 2524 nt, Artificial Sequence; identical to SEQ ID NO: 6605
  KU321639.1 prME-long mRNA Design 2 opt

SEQ ID NO: 6709 - RNA, 2524 nt, Artificial Sequence; identical to SEQ ID NO: 6606
  KU312312.1 prME-long mRNA Design 2 opt

SEQ ID NO: 6710 - RNA, 2512 nt, Artificial Sequence; identical to SEQ ID NO: 6607
  AY632535.2 prME-long mRNA Design 2 opt

SEQ ID NO: 6711 - RNA, 2524 nt, Artificial Sequence; identical to SEQ ID NO: 6608
  KU527068.1 prME-long mRNA Design 2 opt

SEQ ID NO: 6712 - RNA, 2524 nt, Artificial Sequence
  KU720415.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauacgggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6713 - RNA, 2506 nt, Artificial Sequence
  DQ859059.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugaugaaaacagagccaagguggaggucacaccuaauagcccgcgcgcugaggcgacccuuggaggcuucggcucccuggggcucgacugugaaccccggaccggacuggauuuuucugaccuuuacuaucugacaaugaacaauaaacacuggcucgugcauaaggagugguuccacgauaucccucugcccuggcacgccggcgcugacaccgggacaccucauuggaacaauaaagaagcccugguugaguuuaaggaugcccacgcuaagagacagacgguggucgugcucggaagccaggaaggcgccguucauaccgcgcuggcuggggcccuugaggccgagauggacggcgcuaaaggacgccuguucuccggccaccucaagugccggcugaaaauggauaaacuuagacugaagggggugagcuacucucucuguacagccgcuuuuaccuucacaaagguccccgccgaaacccugcauggaacggugaccguggagguucaguaugcgggcacagacgggccgugcaaggucccugcccaaauggcuguggacaugcagacccugacacccgugggacgccucauuaccgccaacccugucaucacggaauccacagagaacagcaaaaugaugcuggaacuugauccucccuuuggcgacucuuacaucgugauugggguuggcgauaagaaaaucacccaccacuggcaucgguccggaagcacaauuggcaaggcuuucgaggccaccgugagaggggcgaaacgcauggccguccugggagacaccgcuugggauuucggcuccguugggggaguguuuaauucucucggcaaggggauccaccagauuuucggcgccgcuuuuaagagccuguucggaggcauguccugguuuucucaaauccugaucgggacacuucucguguggcugggacugaacacgaaaaauggcagcauuucccucaccugucuggcccuugggggagucaugaucuuccugagcacagccgugucugcugacguuggcugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6714 - RNA, 2524 nt, Artificial Sequence
  KX377335.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccgcaagaaaggcgaagccagacggagccgcagagcggugacccuuccgucccauucuacacggaagcugcaaacccgcagccagacauggcucgaguccagagaguauaccaagcaccugauuaaaguugaaaauuggaucuuucggaaccccggcuucgcccugguggcugucgccauugcuuggcuccuggggagcucuacgucccagaaggugaucuaccuuguuaugauucugcucaucgccccugcguauagcauucgcugcaucggagugucuaauagagauuuugucgagggcauguccgggggaacauggguggacgugguccuggaacauggcggguguguuaccgugauggcccaggauaaacccacaguggacaucgagcuugucaccaccacagugagcaacauggcugagguucggucuuacugcuacgaagccuccauuagcgauauggcuuccgacucuagauguccuacgcaaggagaggccuaucuggacaagcagagcgauacccaguacgugugcaaacgcacacucgucgaccggggcuggggcaauggguguggacuguucggcaaggggucccuggugaccugcgccaaguuuacaugcagcaaaaagaugaccggaaaaucuauccagcccgaaaaccucgaguauagaauuaugcuguccguucacggcagccaacacucugggaugaucgugaaugauacgggauacgaaacagacgagaaccgcgcuaaggucgaggugaccccuaauagcccgcgggcggaagccacccuuggcggcuucgggucccugggacucgauugugagcccagaacaggccuggacuuuucugaucuuuauuaccugaccaugaacaauaaacauuggcucguccacaaggaaugguuccaugacauuccucugcccuggcacgcuggggccgauacaggaacgccucacuggaacaauaaagaggcccugguggaauuuaaggacgcucaugccaagcgccagaccguugugguccucggcagccaggagggggcggugcacacagcucuggccggcgcccuugaggcugaaauggauggagccaaaggcaagcuguucuccgggcaucucaaaugccggcugaagauggacaaacuuagacugaagggaguuagcuauucucucuguaccgcugccuuuacauucaccaaggugcccgcggagacgcugcacggcaccgucacaguggaagugcaguacgccgggaccgacggaccgugcaaaaucccuguucaaauggcugucgauaugcagacacugacccccgugggccgccucaucacggccaacccugugauuacagaguccaccgaaaacagcaagaugaugcuggagcuugacccucccuuuggggauucuuacaucgucauuggcgugggagacaaaaagaucacacaucacuggcaccgguccggcagcaccauugggaaggcuuucgaggccaccguuagaggagcgaaacgcauggccgugcugggcgauacagcuugggacuucggguccgucggaggcguguuuaauucucucgggaagggcauccaucagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6715 - RNA, 2524 nt, Artificial Sequence
  LC002520.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugacggugaaugauaucggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6716 - RNA, 2512 nt, Artificial Sequence
  KU963573.2 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugagaauagagcuaagguggaggucacaccuaacagcccgcgcgcggaagccacccuuggcggcuucgggucccugggacucgacugugagccccggaccggccuggauuuuucugaccuuuauuaccugacaaugaauaacaaacacuggcucgugcauaaggaaugguuccacgauauuccucugcccuggcacgcuggggccgacaccggaacaccucauuggaauaacaaagaggcccuggucgaauuuaaggaugcucacgccaagagacagacggugguugugcucggcagccaggagggggcgguccauaccgcucuggccggcgcccuugaggcugaaauggacggagccaaaggcaagcuguucuccgggcaccucaaaugccgccugaagauggauaaacuucggcugaagggagugagcuauucucucuguacagcugccuuuaccuucacaaagguucccgcggagacccugcauggcacggugaccgucgaagugcaguacgccgggacagacggaccgugcaaaaucccugugcaaauggcuguugacaugcagacccugacacccgucggcagacucaucaccgccaauccugugauuacggaguccacagaaaacagcaagaugaugcuggagcuugauccucccuuuggggacucuuacaucgugauuggcgucggagauaaaaagaucacccaccacuggcaucgcuccggcagcacaauugggaaggcuuucgaggccaccgugcggggagcgaaaagaauggccguucugggcgacaccgcuugggauuucggguccgugggaggcgucuuuaacucucucgggaagggcauccaccagaucuucggagccgcuuuuaaaagccuguucggcgggauguccugguuuucucaaauucugaucggaacacuucucguguggcugggccugaauacgaagaacgggagcauuucccucaccugucuggcccuuggaggcguuaugaucuuccugagcacagccgugucugcugacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6717 - RNA, 2524 nt, Artificial Sequence
  KX694534.2 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggcggggcauucaccagaucuucggagcugcguuuaaaagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6718 - RNA, 2524 nt, Artificial Sequence
  KX447520.1 prME-long mRNA Design 2 opt
ggggcgcugccuacggagguggcagccaucuccuucucggcaucaagcuuaccaugagaaucauuaacgcccggaaggagaaaaagcgcagaggcgcugacgccagcguggggaucgucggacugcuccugaccacagcgauggcugccgaaguuacgcggcgcggcuccgccuacuauauguaccuugauagaaaugacgcuggggaggccauuucuuuccccaccacacugggaaugaacaaaugcuauauccagauuauggaucucggccacaugugugacgcuaccaugagcuacgaaugcccuaugcuggaugaggggguggaaccggacgauguggacuguuggugcaauacaaccuccacaugggucguguauggaaccugucaucacaagaaaggcgaggcccggcgcucuagacgggcgguuacgcuucccagccauuccacccgcaagcugcaaacaagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6719 - RNA, 2524 nt, Artificial Sequence
  KX369547.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggccuggcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcgugggagagaaaaagauuacccaccacuggcaucgguccggcagcacaaucgggaaagccuucgaagcuaccgugagaggagccaagcgcauggcuguccucggcgacaccgccugggauuuuggguccgugggaggcgcccugaacucucuggggaaaggcauucaccagaucuucggagcugcguucaagagccuuuuuggcgggauguccugguucucucaaauccucauuggaacacugcugauguggcucggccugaauacgaagaacgggagcaucucccuuaugugucuggcccucggaggcguucugauuuuucugagcaccgcugugucugccgacgucgggugcuccguggauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6720 - RNA, 2524 nt, Artificial Sequence
  KX447515.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacugguaucgguccggcagcacaaucgggaaagccuuugaagcuaccgugagaggagccaagcgcauggcuguccugggcgacaccgccugggauuucggguccgugggaggcgcccucaacucucuggggaaaggcauucaucagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6721 - RNA, 2524 nt, Artificial Sequence
  KU501217.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaaaucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6722 - RNA, 2524 nt, Artificial Sequence
  KU312314.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugccccaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccuggcucaaauggccguggauaugcagacccucacacccgugggccgccugaucaccgcgaacccuguuaucacggaauccacagagaauagcaagaugaugcuugagcuggacccucccuucggggauucuuacauugucaucggcgugggagagaaaaagauuacccaccacuggcaucgguccggcagcacaaucgggaaagccuuugaagcuaccgugagaggagccaagcgcauggcuguccucggcgacaccgccugggauuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6723 - RNA, 2524 nt, Artificial Sequence
  KX446950.2 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuacccuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaauaccaagaacgggagcaucucccugaugugucuugcccugggaggcguucucauuuuccugagcacagcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6724 - RNA, 2524 nt, Artificial Sequence
  KY003157.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccguggucucugcugacguggggugcuccguugauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6725 - RNA, 2524 nt, Artificial Sequence
  KX811222.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccgcuugggucguguauggaaccugucaucacaagaaaggcgaggcccggcgcucuagacgggcgguuacgcuucccagccauuccacccgcaagcugcaaacaagaccucagaccuggcucgagucucgggaauacacaaagcaccugauccgcguggagaacuggaucuuuagaaaucccggcuucgcccuggcugccgcugccauugcguggcuccuggggagcuccaccagccagaaagucaucuaucuugugaugauucugcucaucgccccugcuuacucuauucggugcaucggaguuuccaaccgcgauuuuguggaaggcaugagcgggggaacgugggucgacguggugcuggagcauggcgggugugucacaguuauggcccaggauaagcccaccguggacauugagcuugugacaaccaccgucucuaauauggcugaagugagauccuacugcuaugaggccagcaucucugauauggccuccgacagccgguguccuacacaaggagaggcuuaccuggacaaacaguccgauacgcaguauguuugcaagagaacccucguggaccgcggcuggggcaacggguguggacuguucggcaaagggucucuggucacaugcgcgaaguuugccugcagcaagaaaaugaccggaaaguccauccagccggagaaucucgaauaccggauuaugcugagcgugcacggcucucaacacuccgggaugaucguuaacgauacaggacaugagaccgacgagaauagagcuaaaguggaaauuacgcccaacagcccucgcgccgaggccacacuuggcggcuucgggucucugggacucgauugugaaccccggaccggccuggacuuuagcgaucuuuauuaccugaccaugaauaacaagcacuggcucguccauaaagagugguuccacgacaucccucugcccuggcacgcuggggccgauacaggaaccccgcauuggaauaacaaggaagcgcugguggaguuuaaagacgcucacgccaagagacagacagucgugguucucggcucccaggagggggccgugcauacggcucuggccggcgcucuugaagccgagauggauggagcgaagggccgccugucuagcgggcaccucaaaugccggcugaagauggacaaacuuagacugaagggagucuccuauagccucuguaccgccgcuuucacauuuaccaaaauuccugccgaaacacugcauggcaccgugacgguugaggugcaguacgcugggaccgacggacccugcaaggucccugcccaaauggcgguggauaugcagacacugacccccgugggccgccucaucacagccaaccccguuaucaccgaaucuacggaaaauuccaagaugaugcuggagcuugacccuccguucggggauagcuacauugucaucggcgugggagagaaaaagauuacacaccacuggcaucggucuggcuccaccaucgggaaggcuuuugaagccacagugagaggagcuaaacgcauggccguccugggcgacaccgccugggauuucgggagcgugggaggcgcucucaacucccuggggaaaggcauucaccagaucuucggagcggccuuuaagucucuguucggcgggaugagcugguuuucccaaauccuuauuggaacccuccugauguggcugggccucaauacaaagaacgggucuaucagccugaugugucuugcucugggaggcguucucauuuuccuguccacggccgugagcgccgacgucgggugcucuguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6726 - RNA, 2524 nt, Artificial Sequence
  KX447516.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucuaaaaaggucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaaaccuacaguggacauugagcuugugaccaccacagucuccaauauggccgaagugagaagcuacugcuaugaggcuucuaucuccgauauggccagcgacucccggugucccacgcagggagaagccuaccuggacaagcaaucugauacccaguauguuugcaaaagaacacucguggaccgcggcuggggcaacggguguggacuguucggcaaggggagccuggugaccugcgcuaaguuugcgugcuccaaaaagaugacaggaaaaagcauccagccugagaaucucgaauaccggauuaugcugucuguccacggcucccagcacagcgggaugaucguuaacgauaccggacaugagacggacgagaauagagccaagguggaaauuacaccgaacucuccccgcgcugaggccacccuuggcggcuucgggagccugggacucgauugugaaccucggaccggccuggacuuuuccgaucuuuauuaccugacaaugaauaacaaacacuggcucguccauaaggagugguuccacgacaucccccugccuuggcacgccggggcugauaccggaacaccccauuggaauaacaaagaagcccugguggaguuuaaggacgcgcacgcuaagagacaaacggucgugguucucggcucucaggagggggccgugcauaccgcccuggcuggcgcccuugaagcugagauggauggagccaaaggccgccugagcuccgggcaccucaagugccggcugaaaauggacaaacuuagacugaagggagucagcuauucucucuguacagcggccuucaccuuuacaaagauuccggcugaaacccugcauggcacggugaccguugaggugcaguacgccgggacagacggaccuugcaagguccccgcucagauggccguggauaugcaaacccugacaccugugggccgccucaucaccgcgaaccccguuaucacggaauccacagagaauagcaaaaugaugcuggagcuugaucccccuuucggggacucuuacauugucaucggcgugggagaaaagaaaauuacccaccacuggcaucgguccggcagcacaaucgggaaggccuuugaggcuaccgugagaggagccaaacgcauggcuguccugggcgacaccgccugggauuucggguccgugggaggcgcccucaacucucuggggaagggcauucaccagaucuucggagcugcguuuaagagccuguucggcgggauguccugguuuucucagauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6727 - RNA, 2524 nt, Artificial Sequence
  KX520666.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgcggcagaaagucaucuaucuugugaugauucugcucaucgcgcccgccuacucuauucgcugcaucggaguuuccaacagagauuuuguggaaggcaugagcgggggaacaugggucgacguggugcuggagcauggcgggugugucaccguuauggcucaggauaagccuacaguggacauugagcuugugaccaccacagucucuaauauggccgaagugcgguccuacugcuaugaggcuagcaucucugauauggccuccgacagcagaugucccacgcaaggagaagccuaccuggacaaacaguccgauacccaguauguuugcaagcgcacacucguggaccggggcuggggcaacggguguggacuguucggcaaagggucucuggugaccugcgcuaaguuugcgugcagcaagaaaaugacaggaaaguccauccagccugagaaucucgaauacagaauuaugcugagcguccacggcucucaacacuccgggaugaucguuaacgauaccggacaugagacggacgagaaucgcgccaaaguggaaauuacaccgaacagcccccgggcugaggccacccuuggcggcuucgggucucugggacucgauugugaaccuagaaccggccuggacuuuagcgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcgccagacggucgugguucucggcucccaggagggggccgugcauaccgcccuggcuggcgcccuugaagcugagauggauggagccaagggccggcugucuagcgggcaccucaaaugcagacugaagauggacaaacuucgccugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccggcucaucaccgcgaaccccguuaucacggaaucuacagaaaauuccaagaugaugcuggagcuugaucccccuuucggggacagcuacauugucaucggcgugggagagaaaaagauuacccaccacuggcauagaucuggcuccacaaucgggaaagccuuugaggcuaccgugcgcggagccaagcggauggcuguccugggcgacaccgccugggauuucgggagcgugggaggcgcccucaacucccuggggaaaggcauucaccagaucuucggagcugcguuuaagucucuguucggcgggaugagcugguuuucccaaauccuuauuggaacacuccugauguggcugggccucaauacgaagaacgggucuaucagccugaugugucuugcccugggaggcguucucauuuuccuguccaccgcugugagcgccgacgucgggugcucuguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6728 - RNA, 2524 nt, Artificial Sequence
  KU729218.1 prME-long mRNA Design 2 opt
ggggcgcugccuacggagguggcagccaucuccuucucggcaucaagcuuaccaugagaaucauuaacgcccggaaggagaaaaagcgcagaagcgcugacaccuccgugggcaucgucgggcugcuccugacaacggccauggcggcugaaguuacccggcgcggaucugccuacuauauguaccuugauagaaaugacgccggcgaggcuauuagcuuccccacaacccuggggaugaacaaaugcuauauccagauuauggaucucggacacaugugugacgccacaauguccuacgaaugcccuaugcuggaugagggcguggaaccggacgauguggacuguuggugcaauaccacaucuaccugggucguguaugggacgugucaucacaagaaaggagaggcucggcgcagcagacgggccguuacccuucccucccauucuacacgcaagcugcaaaccagaagccagacauggcucgagucccgggaauacaccaagcaccugauccgcguggagaacuggaucuuuagaaauccuggcuucgcgcuggccgcugccgcuauugccuggcuccugggcagcucuacgucccagaaagucaucuaucuugugaugauucugcucaucgcgcccgccuacagcauucggugcaucgggguuucuaaccgcgauuuuguggaaggaauguccggcgggacaugggucgacguggugcuggagcauggaggcugugucaccguuauggcucaggauaagccuacaguggacauugagcuugugaccaccacagucagcaauauggccgaagugagaucuuacugcuaugaggcuuccaucagcgauauggccuccgacucucggugucccacgcaaggggaagccuaccuggacaaacagagcgauacccaguauguuugcaagagaacacucguggaccgcggauggggcaacggcugugggcuguucggaaaaggcucccuggugaccugcgcuaaguuugcgugcagcaagaaaaugacagggaagucuauccagccugagaaucucgaauaccggauuaugcuguccgugcacggaagccaacacucuggcaugaucguuaacgauaccgggcaugagacggacgagaauagagccaaaguggaaauuacaccgaacagcccccgcgcugaggccacccuuggaggcuucggcucccuggggcucgauugugaaccucggaccggacuggacuuuucugaucuuuauuaccugacaaugaauaacaagcacuggcucguccauaaagagugguuccacgacaucccccugccuuggcacgccggcgcugauaccgggacaccccauuggaauaacaaggaagcccugguggaguuuaaagacgcgcacgcuaagagacagacggucgugguucucggaagccaggagggcgccgugcauaccgcccuggcuggggcccuugaagcugagauggauggcgccaagggacgccuguccagcggccaccucaaaugccggcugaagauggacaaacuuagacugaagggggucucuuauucccucuguacagcggccuucaccuuuacaaaaauuccggcugaaacccugcauggaacggugaccguugaggugcaguacgccggcacagacgggccuugcaagguccccgcucaaauggccguggauacccagacacugaccccugugggacgccucaucacggcgaaccccguuaucacagaaagcaccgaaaauucuaagaugaugcuggagcuugaucccccuuucggcgacuccuacauugucaucggggugggcgagaaaaagauuacacaccacuggcaucggagcggauccaccaucggcaaagccuuugaggcuaccgugagaggggccaagcgcauggcuguccugggagacacagccugggauuucggcucugucgggggagcccucaacagccugggcaaagggauucaccagaucuucggcgcugcguuuaagucccuguucggaggcaugucuugguuuagccaaauccuuauugggacgcuccugauguggcugggacucaauaccaagaacggcuccaucagccugaugugucuugcccucgggggaguucugauuuuccugucuacagcuguguccgccgacgucggcugcagcguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6729 - RNA, 2524 nt, Artificial Sequence
  KU761561.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggaucuuuagaaacccuggcuucgcgcuggccgcugccgcuauugccuggcuccuggggagcuccacgagccagaaagucaucuaucuugugaugauucugcucaucgcgcccgccuacucuauucggugcaucggaguuuccaaucgcgauuuuguggaaggcaugagcgggggaacaugggucgacguggugcuggagcauggcgggugugucaccguuauggcucaggauaagccuacaguggacauugagcuugugaccaccacagucucuaacauggccgaagugagauccuacugcuaugaggcuagcaucucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggauuaugcugagcguccacggcucucaacacuccgggaugaucguuaaugauaccggacaugagacggacgagaacagagccaaaguggaaauuacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacaucccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaucccguuaucacggaaucuacagagaacuccaagaugaugcuggagcuugaucccccuuucggggacagcuacauugucaucggcgugggagagaaaaagauuacccaccacuggcaucggucuggcuccacaaucgggaaagccuuugaagcuaccgugagaggagcccgccggauggcuguccugggcgacaccgccugggauuucgggagcgugggaggcgcccucaauucccuggggaagggcauucaccagaucuucggagcugcguuuaaaucucuguucggcgggaugagcugguuuucccaaauccuuauuggaacacuccugauguggcugggccucaacacgaagaaugggucuaucagccugaugugucuugcccugggaggcguucucauuuuccuguccaccgcugugagcgccgacgucgggugcucuguggauuuuuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6730 - RNA, 2524 nt, Artificial Sequence
  KY317938.1 prME-long mRNA Design 2 opt
ggggcgcugccuacggagguggcagccaucuccuucucggcaucaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgacuuuguggagggcaugucugggggaacaugggucgauguggugcuggagcauggcgggugugucaccguuauggcucaggacaagccuacaguggauauugaacuugugaccaccacagucuccaauauggccgaggugagaagcuacugcuaugaggcuucuaucuccgacauggccagcgauucccggugucccacgcaaggagaagccuaccuggacaaacagucugacacccaguauguuugcaagagaacacucguggaucgcggcuggggcaacggguguggacuguucggcaaagggagccuggugaccugcgcuaaguuugcgugcuccaagaaaaugacaggaaagagcauccagccugaaaaucucgaguaccggauuaugcugucuguccacggcucccaacacagcgggaugaucguuaacgacaccggacaugagacggaugaaaauagagccaaaguggagauuacaccgaacucuccccgcgcugaagccacccuuggcggcuucgggagccugggacucgacugugagccucggaccggccuggauuuuuccgaccuuuauuaccugacaaugaauaacaagcacuggcucguccauaaagaaugguuccacgauaucccccugccuuggcacgccggggcugacaccggaacaccccauuggaauaacaaggaggcccugguggaguuuaaagaugcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6731 - RNA, 2524 nt, Artificial Sequence
  KY075939.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacucccugcggugcauuggaguuagcaaccgcgauuuuguggaaggcaugucugggggaacaugggucgacguggugcuugagcauggcgggugugucaccguuauggcucaggauaagccuacaguggacaucgagcuggugaccaccacagucuccaauauggccgaagugagaagcuacugcuaugaggcuucuauuuccgauauggccagcgacucccggugucccacgcaaggagaagccuaccucgacaaacagucugauacccaguauguuugcaagagaacacugguggaccgcggcuggggcaacggguguggacuguucggcaaagggagccucgugaccugcgcuaaguuugcgugcuccaagaaaaugacaggaaagagcauccagccugagaaucuggaauaccggaucaugcuuucuguccacggcucccaacacagcgggaugauuguuaacgauaccggacaugagacggacgagaauagagccaaaguggaaaucacaccgaacucuccccgcgcugaggccacccugggcggcuucgggagccucggacuggauugugaaccucggaccggccuugacuuuuccgaucuguauuaccucacaaugaauaacaagcacuggcugguccauaaagagugguuccacgacauuccccugccuuggcacgccggggcugauaccggaacaccccauuggaauaacaaggaagcccucguggaguuuaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuucaccuuuacaaaaaucccggcugaaacccugcauggcacggugaccguugaggugcaguacgccgggacagacggaccuugcaagguccccgcucaaauggccguggauaugcagacccucacaccugugggccgccugauuaccgcgaaccccguuaucacggaauccacagagaauagcaagaugaugcuugagcuggaucccccuuucggggacucuuacaucgucauuggcgugggagagaaaaagaucacccaccacuggcaucgguccggcagcacaauugggaaagccuuugaagcuaccgugagaggagccaagcgcauggcuguccucggcgacaccgccugggauuucggguccgugggaggcgcccugaacucucuggggaaaggcauccaccagauuuucggagcugcguuuaagagccuuuucggcgggauguccugguuuucucaaauccucaucggaacacugcugauguggcucggccugaauacgaagaacgggagcauuucccuuaugugucuggcccucggaggcguucugaucuuccugagcaccgcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6732 - RNA, 2524 nt, Artificial Sequence
  KX806557.2 prME-long mRNA Design 2 opt
ggggcgcugccuacggagguggcagccaucuccuucucggcaucaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggauguuuagaaacccuggcuucgcgcuggccgcugccgcuaucgccuggcuccuggggagcuccacgagccagaaagucauuuaucuugugaugauccugcucauugcgcccgccuacucuauccggugcauuggaguuuccaaucgcgauuuuguggaaggcaugagcgggggaacaugggucgacguggugcuggagcauggcgggugugucaccguuauggcucaggauaagccuacaguggacaucgagcuugugaccaccacagucucuaacauggccgaagugagauccuacugcuaugaggcuagcauuucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggaucaugcugagcguccacggcucucaacacuccgggaugauuguuaaugauaccggacaugagacggacgagaacagagccaaaguggaaaucacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacauuccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucauuaccgcgaaucccguuaucacggaaucuacagagaacuccaagaugaugcuggagcuugaucccccuuucggggacagcuacaucgucauuggcgugggagagaaaaagaucacccaccacuggcaucggucuggcuccacaauugggaaagccuuugaagcuaccgugagaggagccaagcgcauggcuguccugggcgacaccgccugggauuucgggagcgugggaggcgcccucaauucccuggggaaaggcauccaccagauuuucggagcugcguuuaagucucuguucggcgggaugagcugguuuucccaaauccuuaucggaacacuccugauguggcugggccucaacacgaagaaugggucuauuagccugaugugucuugcccugggaggcguucucaucuuccuguccaccgcugugagcgccgacgucgggugcucuguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6733 - RNA, 2524 nt, Artificial Sequence
  KU870645.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggauccugagaaauccuggcuuugcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcauuggagagaaaaagaucacccaccacuggcaucgguccggcagcacaauugggaaagccuucgaagcuaccgugagaggagccaagcgcauggcugugcucggcgacaccgccugggauuuuggguccgucggaggcgcccugaacucucuggggaaaggcauccaccagaucuucggagcugcguucaagagccuuuuuggcgggauguccugguucucucaaauucucaucggaacacugcugauguggcucggccugaauacgaagaacgggagcauuucccuuaugugucuggcccucggaggcgugcugaucuuucugagcaccgcuguuucugccgacguggggugcuccgucgauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6734 - RNA, 2524 nt, Artificial Sequence
  KU729217.2 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuuguguccaccaccgucagcaauauggccgaagugagaucuuacugcuaugaggcuacaaucuccgauaucgccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggccgucgugcucggcucucaggagggggccguucauaccgcucuggccggcgcucuugaagccgagauggauggagcgaagggccgccugagcuccgggcaccucaaaugccggcugaagauggacaaacuuagacugaagggagugagcuauucucucuguacagccgcuuucaccuuuacaaaaaucccggccgaaacccugcauggcacggucaccguggagguucaguacgcugggacagacggaccuugcaaggugcccgcccaaauggcggucgauaugcagacccugacaccugugggccgccucaucaccgccaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaggcuuuugaagccaccgugagaggagcuaaacgcauggccgugcugggcgacaccgccugggauuucggguccgucggaggcgcucucaacucucuggggaaaggcauccaccagaucuucggagcggccuuuaagagccuguucggcgggauguccugguuuucucaaauucuuaucggaacacuccugauguggcugggccucaauacgaagaacgggagcauuucccugaugugucuugcucugggaggcgugcucaucuuccugagcaccgccguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6735 - RNA, 2524 nt, Artificial Sequence
  KU497555.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcacccaggagggggccgugcauacagcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaaucuaccgaaaauuccaagaugaugcuggagcuugaucccccuuucggggacagcuacauugucaucggcgugggagagaaaaagauuacacaccacuggcaucggucuggcuccaccaucgggaaagccuuugaggcuaccgugagaggagccaagcgcauggcuguccugggcgacacagccugggauuucgggagcgugggaggcgcccucaacucccuggggaaaggcauucaccagaucuucggagcugcguuuaagucucuguucggcgggaugagcugguuuucccaaauccuuauuggaacgcuccugauguggcugggccucaauaccaagaacgggucuaucagccugaugugucuugcccugggaggcguucucauuuuccuguccacagcugugagcgccgacgucgggugcucuguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6736 - RNA, 2524 nt, Artificial Sequence
  KX087101.3 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugagcugcaguacgccgggacagacggaccuugcaaggugcccgcucaaauggccgucgauaugcagacccucacaccugugggccgccugaucaccgcgaaccccgugaucacggaauccacagagaauagcaagaugaugcuugagcuggaucccccuuucggggacucuuacauuguuaucggcgucggagagaaaaagauuacccaccacuggcaucgguccggcagcacaaucgggaaagccuuugaagcuaccgugagaggagccaagcgcauggcugugcucggcgacaccgccugggauuucggguccgucggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcgugcugauuuuccugagcaccgcuguuucugccgacguggggugcuccgucgauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6737 - RNA, 2524 nt, Artificial Sequence
  KY075932.1 prME-long mRNA Design 2 opt
ggggcgcugccuacggagguggcagccaucuccuucucggcaucaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcaucgaaaacuggauuuuuagaaauccuggcuucgcgcuggccgcugccgcuaucgccuggcuccugggguccagcacgucucagaaagugauuuaucuugucaugauccugcucauugcgcccgccuacuccauccggugcauuggagugagcaaccgcgacuuuguugagggcaugucugggggaacauggguggaugucgugcuggagcauggcgggugugugaccgucauggcucaggacaagccuacaguugauaucgaacuugugaccaccacaguguccaauauggccgaggucagaagcuacugcuaugaggcuucuaucuccgacauggccagcgauucccggugucccacgcaaggagaagccuaccuggacaaacagucugacacccaguaugugugcaagagaacacucguugaucgcggcuggggcaacggguguggacuguucggcaaagggagccuggugaccugcgcuaaguuugcgugcuccaagaaaaugacaggaaagagcauucagccugaaaaucucgaguaccggaucaugcugucuguccacggcucccaacacagcgggaugauugugaacgacaccggacaugagacggaugaaaauagagccaaaguugagaucacaccgaacucuccccgcgcugaagccacccuuggcggcuucgggagccugggacucgacugugagccucggaccggccuggauuuuuccgaccuuuauuaccugacaaugaauaacaagcacuggcucgugcauaaagaaugguuccacgauauuccccugccuuggcacgccggggcugacaccggaacaccccauuggaauaacaaggaggcccuggucgaguuuaaagaugcgcacgcuaagagacagacgguggucgugcucggcucucaggaaggggccguucauaccgcccuggcuggcgcccuugaggcugaaauggacggagccaagggccgccugagcuccgggcaccucaaaugccggcugaagauggauaaacuuagacugaagggagugagcuauucucucuguacagcggccuucaccuuuacaaaaaucccggcugagacccugcauggcacggucaccguggaaguucaguacgccgggacagacggaccuugcaaggugcccgcucaaauggccgucgacaugcagacccugacaccugugggccgccucaucaccgcgaaccccgugauuacggaguccacagagaauagcaagaugaugcuggaacuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgauaccgccugggacuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgauguggggugcuccgucgacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6738 - RNA, 2524 nt, Artificial Sequence
  KY014317.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccauugagaauagcaagaugaugcuggagcuugaucccccuuucggggacucuuacaucgucauuggcgugggagagaaaaagaucacacaccacuggcaucgguccggcagcaccauugggaaagccuuugaagcuacagugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacccuccugauguggcugggccucaauacaaagaacgggagcauuucccugaugugucuugcccugggaggcguucucaucuuccugagcacggcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6739 - RNA, 2524 nt, Artificial Sequence
  KU758876.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagucaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucuccuucaugugucuggcgcuuggaggcgugcugauuuuucucagcaccgccgucucugcugacguggggugcuccguugauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6740 - RNA, 2524 nt, Artificial Sequence
  KU758874.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggcaaacugagcuccgggcaccucaagugccgccugaaaauggacaaacuucggcugaagggagucagcuauucucucuguacagcggccuucaccuuuacaaagauuccggcugaaacccugcauggcacggugaccguugaggugcaguacgccgggacagacggaccuugcaagguccccgcucaaauggccguggauaugcagacccugacaccugugggcagacucaucaccgcgaaccccguuaucacggaauccacagagaauagcaaaaugaugcuggagcuugaucccccuuucggggacucuuacauugucaucggcgugggagaaaagaaaauuacccaccacuggcaucgcuccggcagcacaaucgggaaggccuuugaggcuaccgugcggggagccaaaagaauggcuguccugggcgacaccgccugggauuucggguccgugggaggcgcccucaacucucuggggaagggcauucaccagaucuucggagcugcguuuaagagccuguucggcgggauguccugguuuucucaaauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6741 - RNA, 2524 nt, Artificial Sequence
  KY014314.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagaggcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6742 - RNA, 2524 nt, Artificial Sequence
  KU926310.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccggggcugacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6743 - RNA, 2524 nt, Artificial Sequence
  KU761560.1 prME-long mRNA Design 2 opt
ggggcgcugccuacggagguggcagccaucuccuucucggcaucaagcuuaccaugagaaucauuaacgccggcaaggagaaaaagcggcgcggggcugacaccaaugugggaaucgucggccugcuccugacaacggccauggcggcugaaguuaccagacgggggagcgccuacuauauguaccuugaucgcaacgacgccggagaggcuauuuccuuccccacaacccugggcaugaauaaaugcuauauccagauuauggaucucgggcacaugugugacgccacaaugucuuacgaaugcccuaugcuggaugagggaguggaaccggacgauguggacuguuggugcaacaccacaagcaccugggucguguauggcacgugucaucacaagaaaggcgaggcuagacggucccgcagagccguuacccuucccucucauagcacacggaagcugcaaacccgcucccagacauggcucgagucuagagaauacaccaagcaccugauccggguggagaauuggaucuuucgcaacccuggguucgcgcuggccgcugccgcuauugccuggcuccugggaagcuccacgagccagaaagucaucuaucuugugaugauucugcucaucgcgcccgccuacucuauuagaugcaucggcguuuccaaucgggauuuuguggaagggaugagcggaggcacaugggucgacguggugcuggagcaugggggaugugucaccguuauggcucaggauaagccuacaguggacauugagcuugugaccaccacagucucuaacauggccgaagugcgcuccuacugcuaugaggcuagcaucucugauauggccuccgacagcagaugucccacgcaaggcgaagccuaccuggacaaacaguccgauacccaguauguuugcaagcggacacucguggacagaggcugggggaauggauguggccuguucgggaaaggaucucuggugaccugcgcuaaguuugcgugcagcaagaaaaugacaggcaaguccauccagccugagaaccucgaauaccgcauuaugcugagcguccacgggucucaacacuccggaaugaucguuaaugauaccggccaugagacggacgagaaccgggccaaaguggaaauuacaccgaauagccccagagcugaggccacccuuggcggguucggaucucugggccucgauugugaaccucgcaccgggcuggacuuuagcgaucuuuauuaccugacaaugaacaauaagcacuggcucguccauaaagagugguuccacgacaucccccugccuuggcacgccggagcugauaccggcacaccccauuggaacaacaaggaagcccugguggaguuuaaagacgcgcacgcuaagcggcagacggucgugguucucgggucccaggagggcgccgugcauaccgcccuggcuggagcccuugaagcugagauggauggcgccaaggggagacugucuagcggacaccucaaaugccgccugaagauggacaaacuucggcugaagggcgucuccuauagccucuguacagcggccuucaccuuuacaaaaauuccggcugaaacccugcaugggacggugaccguugaggugcaguacgccggaacagacggcccuugcaagguccccgcucaaauggccguggauaugcagacccugacaccuguggggagacucaucaccgcgaaucccguuaucacggaaucuacagagaacuccaagaugaugcuggagcuugaucccccuuucggcgacagcuacauugucaucggagugggcgagaaaaagauuacccaccacuggcaucgcucuggguccacaaucggaaaagccuuugaagcuaccgugcggggcgccagacgcauggcuguccugggggacaccgccugggauuucggaagcgugggcggggcccucaauucccugggcaagggcauucaccagaucuucggagcugcguuuaaaucucuguucgggggaaugagcugguuuucccaaauccuuauuggcacacuccugauguggcuggggcucaacacgaagaauggaucuaucagccugaugugucuugcccugggcgggguucucauuuuccuguccaccgcugugagcgccgacgucggcugcucuguggauuuuuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6744 - RNA, 2524 nt, Artificial Sequence
  KY317939.1 prME-long mRNA Design 2 opt
ggggcgcugccuacggagguggcagccaucuccuucucggcaucaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaagaugccggggaagcuauuucuuuccccacaacccugggaaugaauaagugcuauauccagauuauggaccucggccacaugugugaugccacaaugagcuacgagugcccuaugcuggacgaagggguggagccggaugacguggauuguuggugcaacaccacauccaccugggucguguauggaacgugucaucacaaaaagggcgaggcucggcgcucuagacgggccguuacccuucccagccauuccacacgcaagcugcaaaccagaucucagacauggcucgaaagccgggaguacaccaaacaccugauccgcguggaaaauuggaucuuuagaaacccuggcuucgcgcuggccgcugccgcuauugccuggcuccugggguccagcacgucucagaaggucaucuaucuugugaugauucugcucaucgcgcccgccuacuccauucggugcaucggaguuagcaaucgcgacuuuguggagggcaugucugggggaacaugggucgauguggugcuggagcauggcgggugugucaccguuauggcucaggacaaaccuacaguggauauugaacuugugaccaccacagucuccaacauggccgaggugagaagcuacugcuaugaggcuucuaucuccgacauggccagcgauucccggugucccacgcaaggagaagccuaccuggacaagcagucugacacccaguauguuugcaaaagaacacucguggaucgcggcuggggcaauggguguggacuguucggcaaggggagccuggugaccugcgcuaaguuugcgugcuccaaaaagaugacaggaaaaagcauccagccugaaaaccucgaguaccggauuaugcugucuguccacggcucccaacacagcgggaugaucguuaaugacaccggacaugagacggaugaaaacagagccaagguggagauuacacccaauucuccgcgcgcugaagccacccuuggcggcuucgggagccugggacucgacugugagccucggaccggccuggauuuuuccgaccuuuauuaccugacaaugaacaauaaacacuggcucguccauaaggaaugguuccacgauaucccccugccuuggcacgccggggcugacaccggaacaccccauuggaacaauaaagaggcccugguggaguuuaaggaugcgcacgcuaagagacagacggucgugguucucggcucucaggaaggggccgugcauaccgcccuggcuggcgcccuugaggcugaaauggacggagccaaaggccgccugagcuccgggcaccucaagugccggcugaaaauggauaaacuuagacugaagggagucagcuauucucucuguacagcggccuucaccuuuacaaagauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaacagcaaaaugaugcuggaacuugaucccccuuucggggacucuuacauugucaucggcgugggagagaagaaaauuacccaccacuggcaucgguccggcagcacaaucgggaaggccuuugaagcuaccgugagaggagccaaacgcauggcuguccugggcgauaccgccugggacuucggguccgugggaggcgcccucaauucucuggggaagggcauucaccagaucuucggagcugcguuuaagagccuguucggcgggauguccugguuuucucaaauccuuauuggaacacuccugauguggcugggccucaacacgaaaaaugggagcaucucccugaugugucuugcccugggaggcguucucauuuuccugagcaccgcugugucugccgaugucgggugcuccguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6745 - RNA, 2524 nt, Artificial Sequence
  KY075937.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauaugguuagcgacucccggugucccacgcaaggagaagccuaccuggacaaacagucugauacccaguaugugugcaagagaacacucgucgaccgcggcuggggcaacggguguggacuguucggcaaagggagccuggugaccugcgccaaguuugcuugcuccaagaaaaugacaggaaagagcauccagccugagaaucucgaauaccggauuaugcugucuguucacggcucccaacacagcgggaugaucgugaacgauaccggacaugagacggacgagaauagagcgaaagucgaaauuacaccgaacucuccccgcgccgaggcuacccuuggcggcuucgggagccugggacucgauugugaaccucggaccggccuggacuuuuccgaucuuuauuaccugacaaugaauaacaagcacuggcucgugcauaaagagugguuccacgacaucccccugccuuggcacgccggggccgauaccggaacaccccauuggaauaacaaggaagcucuggucgaguuuaaagacgcccacgcgaagagacagacggugguugugcucggcucucaggagggggcuguccauaccgcccuggccggcgcucuugaagccgagauggauggagcuaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucucccugaugugucuugcgcugggaggcgugcucauuuuccugagcaccgccgucucugcugacguggggugcuccguugauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6746 - RNA, 2524 nt, Artificial Sequence
  LC191864.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaugaccagcacaugggucguguauggaaccugucaucacaagaaaggcgaggcucggcgcuccagacgggccguuacgcuucccucucauagcacccgcaagcugcaaacaagaucccagaccuggcucgagucucgggaauacacaaagcaccugauccgcguggagaauuggaucuuuagaaacccuggcuucgcgcuggccgcugccgcuauugccuggcuccuggggagcuccaccagccagaaagucaucuaucuugugaugauucugcucaucgcgcccgccuacucuauucggugcaucggaguuuccaaucgcgauuuuguggaaggcaugagcgggggaacgugggucgacguggugcuggagcauggcgggugugucacaguuauggcucaggauaagccuaccguggacauugagcuugugacaaccaccgucucuaacauggccgaagugagauccuacugcuaugaggcuagcaucucugauauggccuccgacagccggugucccacacaaggagaagccuaccuggacaaacaguccgauacgcaguauguuugcaagagaacccucguggaccgcggcuggggcaauggguguggacuguucggcaaagggucucuggucacaugcgcuaaguuugcgugcagcaagaaaaugaccggaaaguccauccagccugagaaccucgaauaccggauuaugcugagcgugcacggcucucaacacuccgggaugaucguuaaugauacaggacaugagaccgacgagaacagagccaaaguggaaauuacgccgaauagcccccgcgcugaggccacacuuggcggcuucgggucucugggacucgauugugaaccucggaccggccuggacuuuagcgaucuuuauuaccugaccaugaacaauaagcacuggcucguccauaaagagugguuccacgacaucccccugccuuggcacgccggggcugauacaggaacaccccauuggaacaacaaggaagcccugguggaguuuaaagacgcgcacgcuaagagacagaccgucgugguucucggcucccaggagggggccgugcauacggcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacacugcauggcaccgugacgguugaggugcaguacgccgggaccgacggaccuugcaagguccccgcucaaauggccguggauaugcagacacugaccccugugggccgccucaucacagcgaaucccguuaucaccgaaucuacggagaacuccaagaugaugcuggagcuugaucccccuuucggggacagcuacauugucaucggcgugggagagaaaaagauuacacaccacuggcaucggucuggcuccaccaucgggaaagccuuugaagcuacagugagaggagccaagcgcauggcuguccugggcgacaccgccugggauuucgggagcgugggaggcgcccucaauucccuggggaaaggcauucaccagaucuucggagcugcguuuaagucucuguucggcgggaugagcugguuuucccaaauccuuauuggaacccuccugauguggcugggccucaacacaaagaaugggucuaucagccugaugugucuugcccugggaggcguucucauuuuccuguccacggcugugagcgccgacgucgggugcucuguggauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6747 - RNA, 2524 nt, Artificial Sequence
  KX447517.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccgcccuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaacccuuaucggaacacuccugauguggcugggccucaauacgaagaacgggagcauuucccugaugugucuugcucugggaggcguucucaucuuccugagcaccgccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6748 - RNA, 2524 nt, Artificial Sequence
  KU922923.1 prME-long mRNA Design 2 opt
ggggcgcugccuacggagguggcagccaucuccuucucggcaucaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugccccaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcuggccuacuccauucggugcaucggaguuagcaaccgcgacuuuguggagggcaugucugggggaacaugggucgauguggugcuugagcauggcgggugugucaccguuauggcucaggacaagcccacaguggauauugaacuggugaccaccacagucuccaauauggccgaggugagaagcuacugcuaugaggcuucuaucuccgacauggccagcgauucccgguguccuacgcaaggagaagccuaccucgacaaacagucugacacccaguauguuugcaagagaacacugguggaucgcggcuggggcaacggguguggacuguucggcaaagggagccucgugaccugcgcuaaguuugcgugcuccaagaaaaugacaggaaagagcauccagcccgaaaaucuggaguaccggauuaugcuuucuguccacggcucccaacacagcgggaugaucguuaacgacaccggacaugagacggaugaaaauagagccaaaguggagauuacaccuaacucuccgcgcgcugaagccacccugggcggcuucgggagccucggacuggacugugagccccggaccggccuugauuuuuccgaccuguauuaccucacaaugaauaacaagcacuggcugguccauaaagaaugguuccacgauaucccucugcccuggcacgccggggcugacaccggaacaccucauuggaauaacaaggaggcccucguggaguuuaaagaugcgcacgcuaagagacagacggucgugguucugggcucucaggaaggggccgugcauaccgcccuugcuggcgcccuggaggcugaaauggacggagccaagggccgccucagcuccgggcaccugaaaugccggcuuaagauggauaaacugagacucaagggagucagcuauucucuguguacagcggccuucaccuuuacaaaaauucccgcugagacccugcauggcacggugaccguugaagugcaguacgccgggacagacggaccgugcaaggucccugcucaaauggccguggacaugcagacccucacacccgugggccgccugaucaccgcgaacccuguuaucacggaguccacagagaauagcaagaugaugcuugaacuggauccucccuucggggacucuuacauugucaucggcgugggagagaaaaagauuacccaccacuggcaucgguccggcagcacaaucgggaaagccuuugaagcuaccgugagaggagccaagcgcauggcuguccucggcgauaccgccugggacuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgaugucgggugcuccguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6749 - RNA, 2524 nt, Artificial Sequence
  KY003156.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaauuagcaaccgcgauuuuguugaaggcaugucugggggaacauggguggacgucgugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggauucugggacucgauugugaaccucggaccggccuggacuuuagcgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagagacagacgguggucgugcucggcucccaggagggggccguucauaccgcccuggcuggcgcccuugaagcugagauggauggagccaagggccgccugucuagcgggcaccucaaaugccggcugaagauggacaaacuuagacugaagggaguguccuauagccucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucauuaccgcgaaccccgugaucacggaaucuacagaaaauuccaagaugaugcuggagcuugaucccccuuucggggacagcuacauuguuaucggcgucggagagaaaaagauuacccaccacuggcaucggucuggcuccacaaucgggaaagccuuugaggcuaccgugagaggagccaagcgcauggcugugcugggcgacaccgccugggauuucgggagcgucggaggcgcccucaacucccuggggaaaggcauccaccagauuuucggagcugcguuuaagucucuguucggcgggaugagcugguuuucccaaauccuuauuggaacacuccugauguggcugggccucaauacgaagaacgggucuaucagccugaugugucuugcccugggaggcgugcucauuuuccuguccaccgcuguuagcgccgacguggggugcucugucgauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6750 - RNA, 2524 nt, Artificial Sequence
  KU312313.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccauccgcaagcugcaaaccagaucucagacauggcucgagagccgggaauacaccaagcaccugauccgcguggagaacuggauuuuuagaaauccuggcuucgcgcuggccgcugccgcuaucgccuggcuccugggguccagcacgucucagaaagucauuuaucuugugaugauccugcucauugcgcccgccuacuccauccggugcauuggaguuagcaaccgcgauuuuguggaaggcaugucugggggaacaugggucgacguggugcuggagcauggcgggugugucaccguuauggcucaggauaagccuacaguggacaucgagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucaucaccgcgaaccccguuauuacggaauccacagagaauagcaagaugaugcuggagcuugaucccccuuucggggacucuuacaucgucauuggcgugggagagaaaaagaucacccaccacuggcaucgguccggcagcacaauugggaaagccuuugaagcuaccgugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacacuccugauguggcugggccucaaugccaagaacgggagcauuucccugaugugucuugcucugggaggcguucucaucuuccugagcacggccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6751 - RNA, 2524 nt, Artificial Sequence
  KY075935.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucaacggucucgcagagccguuacccuucccagccauuccacacggaagcugcagacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacguggugcuggagcauggcgggugugucaccguuauggcucaagauaagccuacaguggacauugagcuugugaccaccacagucuccaauauggccgaagugcgcagcuacugcuaugaggcuucuaucuccgauauggccagcgacuccagaugucccacgcagggagaagccuaccuggacaaacagucugauacccaguauguuugcaagcggacacucguggacagaggcuggggcaacggguguggacuguucggcaaagggagccuggugaccugcgcuaaguuugcgugcuccaagaaaaugacaggaaagagcauccaaccugagaaucucgaauaccgcauuaugcugucuguccacggcucccagcacagcgggaugaucguuaacgauaccggacaugagacggacgagaaucgggccaaaguggaaauuacaccgaacucucccagagcugaggccacccuuggcggcuucgggagccugggacucgauugugaaccucgcaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcggcagacggucgugguucucggcucucaggagggggccgugcauaccgcccuggcuggcgcccuugaagcugagauggauggagccaagggcagacugagcuccgggcaccucaaaugccgccugaagauggacaaacuucggcugaagggagucagcuauucucucuguacagcggccuucaccuuuacaaaaauuccggcugaaacccugcauggcacggugaccguugaggugcaauacgccgggacagacggaccuugcaagguccccgcucagauggccguggauaugcagacccugacaccugugggcagacucaucaccgcgaaccccguuaucacggaauccacagagaauagcaagaugaugcuggagcuugaucccccuuucggggacucuuacauugucaucggcgugggagagaaaaagauuacccaccacuggcaucgcuccggcagcacaaucgggaaagccuuugaagcuaccgugcggggagccaagagaauggcuguccugggcgacaccgccugggauuucggguccgugggaggcgcccucaacucucuggggaaaggcauucaccaaaucuucggagcugcguuuaagagccuguucggcgggauguccugguuuucucagauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6752 - RNA, 2524 nt, Artificial Sequence
  KY014320.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaagcgagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6753 - RNA, 2524 nt, Artificial Sequence
  KX827309.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaucugacgccggggaggcuauuagcuuccccacaacccugggaaugaauaaaugcuauauccagauuauggaucucggccacaugugugacgccacaauguccuacgaaugcccuaugcuggaugaggggguggaaccggacgauguggacuguuggugcaacaccacaucuaccugggucguguauggaacgugucaucacaagaaaggcgaggcucggcgcagcagacgggccguuacccuucccucccauucuacacgcaagcugcaaaccagaagccagacauggcucgagucccgggaauacaccaagcaccugauccgcguggagaauuggaucuuuagaaacccuggcuucgcgcuggccgcugccgcuauugccuggcuccuggggagcucuacgucccagaaagucaucuaucuugugaugauucugcucaucgcgcccgccuacagcauucggugcaucggaguuucuaaucgcgauuuuguggaaggcauguccgggggaacaugggucgacguggugcuggagcauggcgggugugucaccguuauggcucaggauaagccuacaguggacauugagcuugugaccaccacagucagcaacauggccgaagugagaucuuacugcuaugaggcuuccaucagcgauauggccuccgacucucggugucccacgcaaggagaagccuaccuggacaaacagagcgauacccaguauguuugcaagagaacacucguggaccgcggcuggggcaauggguguggacuguucggcaaagggucccuggugaccugcgcuaaguuugcgugcagcaagaaaaugacaggaaagucuauccagccugagaaccucgaauaccggauuaugcuguccguccacggcagccaacacucugggaugaucguuaaugauaccggacaugagacggacgagaacagagccaaaguggaaauuacaccgaauagcccccgcgcugaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggcugauaccggaacaccccauuggaacaauaaggaagcccugguggaguuuaaagacgcgcacgcuaagagacagacggucgugguucucggcagccaggagggggccgugcauaccgcccuggcuggcgcccuugaagcugagauggauggagccaagggccgccuguccagcgggcaccucaaaugccggcugaagauggacaaacuuagacugaagggagucucuuauucccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaaagcacagagaacucuaagaugaugcuggagcuugaucccccuuucggggacuccuacauugucaucggcgugggagagaaaaagauuacccaccacuggcaucggagcggcuccacaaucgggaaagccuuugaagcuaccgugagaggagccaagcgcauggcuguccugggcgacaccgccugggauuucgggucugugggaggcgcccucaauagccuggggaaaggcauucaccagaucuucggagcugcguuuaagucccuguucggcgggaugucuugguuuagccaaauccuuauuggaacacuccugauguggcugggccucaacacgaagaauggguccaucagccugaugugucuugcccugggaggcguucucauuuuccugucuaccgcuguguccgccgacgucgggugcagcguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6754 - RNA, 2524 nt, Artificial Sequence
  KU681081.3 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacacaggggccgauacgggaacaccccauuggaacaauaaggaagcccugguggaguuuaaagacgcucacgccaagagacagaccgucgugguucucggcagccaggagggggcggugcauaccgcucuggccggcgcccuugaagcugagauggauggagccaagggccgccuguccagcgggcaccucaaaugccggcugaagauggacaaacuuagacugaagggagucucuuauucccucuguacagcugccuucaccuuuacgaaaauuccggcggaaacccugcauggcacagugaccguugaggugcaguacgccgggacagacggaccuugcaagguccccgcucaaauggccguggauaugcagacccugacgccugugggccgccucaucacagcuaaccccguuaucaccgaagggacagagaacagcaagaugaugcuggagcuugaucccccuuucggcgacucuuacauugucaucggagugggcgagaaaaagauuacccaccacuggcaucgguccgggagcaccaucggaaaagccuuugaagcgacagugagaggcgccaagcgcauggcuguccugggggacacggccugggauuucggauccgugggcgggguucucaauucucugggcaaaggcauucaccagaucuucggagcugccuuuaagagccuguucgggggaauguccugguuuucucaaauccuuauuggcacccuccugauguggcuggggcucaacacaaagaauggaagcaucucccugaugugucuugcccugggcggggugcucauuuuccugagcaccgcugucucugcggacgugggcugcuccguugauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6755 - RNA, 2524 nt, Artificial Sequence
  KU744693.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccgcuauggcccaggauaagccuacaguugacauugagcuugugaccaccacaguguccaauauggcugaagucagaagcuacugcuaugaggccucuaucuccgauauggccagcgacucccggugucccacgcaaggagaggcuuaccuggacaaacagucugauacccaguaugugugcaagagaacacucguugaccgcggcuggggcaacggguguggacuguucggcaaagggagccuggugaccugcgcgaaguuugccugcuccaagaaaaugacaggaaagagcauccagccugaaaaucucgaauaccggauuaugcugucuguccacggcucccaacacagcgggaugcuugugaacgauaccggacaugagacggacgagaauagagcuaaaguugaaaucacaccgaacucuccccgcgccgaggccacccugggcggcuucgggagccucggacuggauugugaaccucggaccggccuugacuuuuccgaucuguauuaccucacaaugaauaacaagcacuggcuggcucauaaagagugguuccacgacauuccccugccuuggcacgccggggcggcuaccggaacaccccauuggaauaacaaggaagcccucguggaguuuaaagaugcccacgcuaagagacagacggucgugguccugggcucucaggagggggccgugcauaccgcucuugccggcgcgcuggaagccgagauggacggagcuaagggccgccucagcuccgggcaccugaaaugccggcuuaagauggauaaacugagacucaagggaguuagcuauucucuguguacagccgcuuucaccuuuacaaaaaucccggccgaaaccguggacggcacggucaccguggaggggcaguacggaggcacagacgggccuugcaagguucccgcgcaaauggccguggauaugcagacccugacaccugucggccgccucauuaccgcuaaccccgugaucacggaauccacagagaauagcaagaugaugcuggagcuugaucccccuuucggagacucuuacaucgugauuggcguuggggagaaaaagaucacccaucacuggcaccgguccggaagcacaauuggcaaagccuuugaagcuaccgucagaggggccaagcgcauggccgugcugggagacaccgcuugggauuucggcuccgucgggggcgcgcucaacucucugggaaaaggcauccaucagauuaucggggccgcuuucaagagccuguuuggaggcauguccugguucucucaaauccuuauugggacacuccugauguggcugggacucaauacgaagaacggcagcaucucccugaugugucuugcccucgggggcgugcugauuuuucugagcaccgccgugucuggaggcguugggugcuccguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6756 - RNA, 2524 nt, Artificial Sequence
  KY328290.1 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuagcaaaauuccggccgaaacccugcauggcacggugaccgaggaaguucaguacgcugggacagacggaccuugcaaggugcccgcccaaauggcugucgauaugcagacccugacaccugugggccgccucaucaccgccaaccccgugaucacggagucuacagagaacuccaagaugaugcuggaacuugaucccccuuucggggacagcuacauuguuaucggcgucggagagaaaaagauuacccaccacuggcaucgguccggcucuacaaucgggaaagcguuugaagccaccgugagaggagcuaagcgcauggccgugcugggcgacaccgcuugggauuucgggagcgucggaggcgcccucaauucccuggggaaaggcauucaccagaucuucggagccgcuuuuaagucucuguucggcgggaugagcugguuuucccaaauccuuauuggaacacuccugauguggcugggccucaacacgaagaaugggagcaucucucugaugugucuugcgcugggaggcgugcucauuuuccuguccaccgccguuagcgcugacguggggugcucugucgauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6757 - RNA, 2524 nt, Artificial Sequence
  KX694532.2 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugaugugucuugcgcugggaggcguucucauuuuccugucuacagccguguccgcugacgucgggugcagcguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6758 - RNA, 2524 nt, Artificial Sequence
  KU955593.1 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccguugaagugacacggcgcggcaaugcguacuauauguaccuugauagauccgacgcuggggaggccauuucuuuccccaccacaaugggaaugaacaaaugcuauauccagauuauggaucugggccacaugugugacgccaccaugagcuacgaaugcccuaugcucgaugaggggguggaaccggacgaugucgacuguuggugcaauacaaccuccacgugggugguuuauggaaccugucaucacaagaaaggcgaggcucggcgcucuagacgggccgugacacugcccagccauuccacccgcaaacuucaaacaagaucucagaccuggcuggagagccgggaauacacgaagcaccucauccgcgucgagaacuggaucuuuagaaauccuggcuucgcucuggccgcggccgcuauugccuggcugcucggguccagcacaucucagaaagugaucuaucugguuaugauucuucugaucgcucccgccuacuccauucggugcaucggagugagcaaccgcgauuuugucgaaggcaugucugggggaaccuggguggacgugguccucgagcauggcggguguguuacagugauggcgcaggauaagccuaccguggacauugagcuggucaccacaacgguguccaauauggccgaaguuagaagcuacugcuaugaggcuucuaucuccgauauggccagcgacucccggugucccacccaaggagaggcuuaccuugacaaacagucugauacacaguaugugugcaagagaacccuggucgaccgcggcuggggcaacggguguggacucuucggcaaagggagccuggugacaugcgccaaguuugccugcuccaagaaaaugaccggaaagagcauccagccugaaaaucuggaauaccggauuaugcucucuguucacggcucccaacacagcgggaugaucgugaacgauacgggacaugagacagacgagaauagagcuaaagucgaaauuaccccgaacucuccccgcgcggaggccacccugggcggcuucgggagccuuggacuggauugugaaccucggacaggccucgacuuuuccgaucuguauuaccuuaccaugaauaacaagcacuggcuggugcauaaagagugguuccacgacaucccccucccuuggcacgcuggggccgauacaggaacgccccauuggaauaacaaggaagcccuggucgaguuuaaagacgcucacgccaagagacagaccgugguugugcugggcucucaggagggggcgguccauacagcucucgccggcgcccuggaagcugagauggauggagccaagggccgccuuagcuccgggcaccugaaaugccggcucaagauggacaaacugagacuuaagggagugagcuauucucuguguaccgcugccuucacauuuaccaaaauuccggcggaaacgcuccauggcaccguuacaguggagguccaguacgccgggaccgacggaccuugcaaggugcccgcucaaauggccguggauaugcagacacugaccccuguuggccgccugaucacggcuaaccccgucaucacagaauccaccgagaauagcaagaugaugcucgagcuggaucccccuuucggggacucuuacauugugaucggcgugggagaaaagaagauuacacaccacuggcaucgguccggcagcaccaucgggaaagccuuugaggcgaccgucagaggagccaagcgcauggcugugcuuggcgacacagccugggauuucggguccguuggaggcgcucugaacucucucgggaaaggcauucaccagaucuucggagccgccuuuaagagccuguucggcgggauguccugguuuucucaaauccugauuggaacgcuucucguguggcugggccugaauaccaagaacgggagcaucucccucaugugucuggcucuuggaggcguccugauuuuccucagcacagcggugucugccgacguugggugcuccguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6759 - RNA, 2524 nt, Artificial Sequence
  KY272987.1 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugguuugucuugcgcugggaggcgugcucauuuuccugucuacagccgucuccgcugacguggggugcagcguugauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6760 - RNA, 2524 nt, Artificial Sequence
  EU545988.1 prME-long mRNA Design 2 opt
ggggcgcugccuacggagguggcagccaucuccuucucggcaucaagcuuaccaugagaaucauuaacgcccggaaggagaaaaagcgcagaggcaccgacacaagcguggggaucgucggacugcuccugacgaccgcuauggccguugaagugacacggcgcggcuccgcguacuauauguaccuugauagaucugacgcuggggaggccauuagcuuccccaccacacugggaaugaauaaaugcuauauccagauuauggaucucggccacaugugugacgccaccauguccuacgaaugcccuaugcuggaugaggggguggaaccggacgaugucgacuguuggugcaacacaaccucuacgugggugguuuauggaaccugucaucacaagaaaggcgaggcucggcgcagcagacgggccgugacacuucccucccauucuacccgcaagcugcaaacaagaagccagaccuggcucgagucccgggaauacacgaagcaccugauccgcgucgagaauuggaucuuuagaaacccuggcuucgcucuggccgcggccgcuauugccuggcuccuggggagcucuacaucccagaaagugaucuaucuuguuaugauucugcucaucgcucccgccuacagcauucggugcaucggagugucuaaucgcgauuuugucgaaggcauguccgggggaaccuggguggacgugguccuggagcauggcggguguguuacagugauggcgcaggauaagccugccguggacauugagcuugucaccaccacagugagcaacauggcugaaguuagaucuuacugcuaugaggccuccaucagcgauauggcuuccgacucucggugucccacgcaaggagaagccuaccuggacaaacagagcgauacccaguaugugugcaagagaacacucgucgaccgcggcuggggcaauggguguggacuguucggcaaagggucccuggugaccugcgccaaguuugcuugcagcaagaaaaugacaggaaagucuauccagccugagaaccucgaauaccggauuaugcuguccguucacggcagccaacacucugggaugaucgugaaugauaccggacaugagacggacgagaacagagcgaaagucgaaauuacaccgaauagcccccgcgccgaggcuacccuuggcggcuucgggucccugggacucgauugugaaccucggaccggccuggacuuuucugaucuuuauuaccugacaaugaacaauaagcacuggcucgugcauaaagagugguuccacgacaucccccugccuuggcacgccggggccgauaccggaacaccccauuggaacaauaaggaagcucuggucgaguuuaaagacgcccacgcgaagagacagacggugguugugcucggcagccaggagggggcuguccauaccgcccuggccggcgcucuugaagccgagauggauggagcuaagggccgccuguccagcgggcaccucaaaugccggcugaagauggacaaacuuagacugaagggagugucuuauucccucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaaagcacagagaacucuaagaugaugcuggagcuugaucccccuuucggggacuccuacauugugaucggcgugggagagaaaaagauuacccaccacuggcaucggagcggcuccacaaucgggaaagcguuugaagccaccgucagaggagcuaagcgcauggccgugcugggcgacaccgcuugggauuucgggucuguuggaggcgcccucaauagccuggggaaaggcauucaccagaucuucggagccgcuuuuaagucccuguucggcgggaugucuugguuuagccaaauccuuauuggaacacuccugguguggcugggccucaacacgaagaauggguccaucagccugaccugucuugcgcugggaggcguccucauuuuccugucuacagccguguccgcugacguugggugcagcguggauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6761 - RNA, 2524 nt, Artificial Sequence
  KU681082.3 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggaaugaauaaaugcuauauccagauuauggaucucggccacaugugugacgcuacaauguccuacgaaugcccuaugcuggaugaggggguggaaccggacgaugucgacuguuggugcaacaccacaucuaccugggugguuuauggaacgugucaucacaagaaaggcgaggcccggcgcagcagacgggcugugacccuucccucccauucuacacgcaagcugcaaaccagaagccagacauggcucgagucccgggaauacaccaagcaccugauccgcgucgagaauuggaucuuuagaaacccuggcuucgcccuggcggccgcugugauugccuggcuccuggggagcucuacgucccagaaaguuaucuaucuugugaugauucugcucaucgcucccgccuacagcauucggugcaucggagucucuaaucgcgauuuuguggaaggcauguccgggggaacauggguggacgucguucuggagcauggcgggugugugaccgugauggcgcaggauaagccuacagucgacauugagcuugugaccaccacaguuagcaacauggccgaagugagaucuuacugcuaugaggcuuccaucagcgauauggccuccgacucucggugucccacgcaaggagaggcuuaccuggacaaacagagcgauacccaguaugucugcaagagaacacucguggaccgcggcuggggcaauggguguggacuguucggcaaagggucccugguuaccugcgccaaguuugccugcagcaagaaaaugacaggaaagucuauccagccugaaaaccucgaauaccggauuaugcuguccgugcacggcagccaacacucugggaugaucgucaaugauaccggacaugagacggacgagaacagagcuaaaguggaaauuacaccgaauagcccccgcgcggaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgcuggggccgauaccggaacaccccauuggaacaauaaggaagcccugguggaguuuaaagacgcucacgccaagagacagacgguugugguccucggcagccaggagggggcggugcauaccgcucuggccggcgcccuugaagcugagauggauggagccaagggccgccuguccagcgggcaccucaaaugccggcugaagauggacaaacuuagacugaagggaguuucuuauucccucuguacagcugccuucaccuuuacaaaaauuccggcggaaacccugcauggcacggugaccgucgaggugcaguacgccgggacagacggaccuugcaaggugcccgcucaaauggccguugauaugcagacccugacaccugucggccgccucaucaccgcuaaccccgugaucacggaaagcacagagaacucuaagaugaugcuggagcuugaucccccuuucggggacuccuacauugugaucggcgucggagagaaaaagauuacccaccacuggcaucggagcggcuccacaaucgggaaagccuuugaagcgaccgugagaggagccaagcgcauggcuguucugggcgacaccgccugggauuucgggucugugggaggcgcucucaauagccuggggaaaggcauucaccagaucuucggagccgccuuuaagucccuguucggcgggaugucuugguuuagccaaauccuuauuggaacacuccuggucuggcugggccucaacacgaagaauggguccaucagccugaccugucuugcucugggaggcgugcucauuuuccugucuacagcgguuuccgccgacguggggugcagcgucgauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6762 - RNA, 2524 nt, Artificial Sequence
  KX601167.1 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggagugaauaaaugcuauauccagauuauggaucucggccacaugugugacgcuacaauguccuacgaaugcccuaugcuggaugagggggucgaaccggacgauguggacuguuggugcaacaccacaucuaccuggguuguguauggaacgugucaucacaagaaaggcgaggcccggcgcagcagacgggcugucacccuucccucccauucuacacgcaagcugcaaaccagaagccagacauggcucgagucccgggaauacaccaagcaccugauccgcguggagaauuggaucuuuagaaacccuggcuucgcccuggcggccgcugccauugcuuggcuccuggggagcucuacgucccagaaaguuaucuaucuugugaugauucugcucaucgcccccgcguacagcauucggugcaucggagucucuaaucgcgauuuuguggaaggcauguccgggggaacauggguggacgucguucuggagcauggcgggugugugaccgugauggcccaggauaagccuacagucgacauugagcuugugaccaccacaguuagcaacauggcugaagugagaucuuacugcuaugaggccuccaucagcgauauggcuuccgacucucggugucccacgcaaggagaagccuaccuggacaaacagagcgauacccaguaugucugcaagagaacacucguggaccgcggcuggggcaauggguguggacuguucggcaaagggucccugguuaccugcgccaaguuugcuugcagcaagaaaaugacaggaaagucuauccagccugagaaccucgaauaccggauuaugcuguccgugcacggcagccaacacucugggaugaucgucaaugauaccggacaugagacggacgagaacagagcgaaaguggaaauuacaccgaauagcccccgcgccgaggcuacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggccgauaccggaacaccccauuggaacaauaaggaagcucugguggaguuuaaagacgcccacgcgaagagacagacgguugugguccucggcagccaggagggggcugugcauaccgcccuggccggcgcucuugaagccgagauggauggagcuaagggccgccuguccagcgggcaccucaaaugccggcugaagauggacaaacuuagacugaagggaguuucuuauucccucuguacagccgcguucaccuuuacaaaaauuccggccgaaacccugcauggcacggugaccgucgaggugcaguacgcugggacagacggaccuugcaaggugcccgcccaaauggcuguugauaugcagacccugacaccugucggccgccucaucaccgccaaccccgugaucacggaaagcacagagaacucuaagaugaugcuggagcuugaucccccuuucggggacuccuacauugugaucggcgucggagacaaaaagauuacccaccacugguaucggagcggcuccacaaucgggaaagcguuugaagccaccgugagaggagcuaagcgcauggccguucugggcgauaccgcuugggacuucgggucugugggaggcgcccucaauagccuggggaaaggcauucaucagaucuucggagccgcuuuuaagucccuguucggcgggaugucuugguuuagccaaauccuuauuggaacacuccuggucuggcugggccucaacacgaagaauggguccaucagccugaccugucuugcgcugggaggcgugcucauuuuccugucuacagccguuuccgcugauguggggugcagcgucgacuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6763 - RNA, 2524 nt, Artificial Sequence
  KX694533.2 prME-long mRNA Design 2 opt
ggggcgcugccuacggagguggcagccaucuccuucucggcaucaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccgggaaagccauuagcuuccccacaacccugggagugaauaagugcuauauccagauuauggaucucggccacaugugugacgcuacaauguccuacgagugcccuaugcuggaugaaggggucgagccggacgauguggacuguuggugcaacaccacaucuaccuggguuguguauggaacgugucaucacaaaaagggcgaagcccggcgcagcagacgggcugucacccuucccucccauucuacacgcaagcugcaaaccagaagccagacauggcucgagucccgggaguacaccaaacaccugauccgcguggaaaauuggaucuuuagaaacccuggcuucgcccuggcggccgcugccauugcuuggcuccuggggagcucuacgucccagaagguuaucuaucuugugaugauucugcucaucgcccccgcguacagcauucggugcaucggagucucuaaucgcgauuuuguggagggcauguccgggggaacauggguggacgucguucuggaacauggcgggugugugaccgugauggcccaggauaaaccuacagucgacauugagcuugugaccaccacaguuagcaacauggcugaggugagaucuuacugcuaugaagccuccaucagcgauauggcuuccgacucucggugucccacgcaaggagaggccuaccuggacaagcagagcgauacccaguaugucugcaaaagaacacucguggaccgcggcuggggcaauggguguggacuguucggcaaggggucccugguuaccugcgccaaguuugcuugcagcaaaaagaugacaggaaaaucuauccagccugaaaaccucgaguaccggauuaugcuguccgugcacggcagccaacacucugggaugaucgucaaugauauuggacaugaaaccgacgagaacagagcgaagguggagaucacgccgaauagcccccgcgccgaagcuacacuuggcggcuucgggucccugggacucgauugugagccucggaccggccuggacuuuucugaucuuuauuaccugaccaugaacaauaaacacuggcucguccauaaggaaugguuccacgacauuccccugccuuggcacgccggggccgauacaggaacaccccauuggaacaauaaagaggcucugguggaauuuaaggacgcccacgcgaagagacagacaguugugguccucggcagccaggagggggcugugcauacggcccuggccggcgcucuugaggccgaaauggauggagcuaaaggccgccuguccagcgggcaccucaagugccggcugaaaauggacaaacuuagacugaagggaguuucuuauucccucuguaccgccgcguucacauuuaccaagaucccggccgagacacugcauggcaccgugacggucgaagugcaguacgcugggaccgacggaccuugcaaggugcccgcccaaauggcuguugauaugcagacacugaccccugucggccgccucaucacagccaaccccgugauuaccgagagcacggaaaacucuaaaaugaugcuggagcuugaucccccuuucggggacuccuacaucgugauuggcgucggagacaagaaaaucacacaccacuggcaucggagcggcuccaccauugggaaggcguuugaggccacagugagaggagcuaaacgcauggccguucugggcgauaccgcuugggacuucgggucugugggaggcgcccucaauagccuggggaagggcauccaccagaucuucggagccgcuuuuaagucccuguucggcgggaugucuugguuuagccaaauucuuaucggaacccuccuggucuggcugggccucaacaccaaaaauggguccauuagccugacgugucuugcgcugggaggcgugcucaucuuccugucuaccgccguuuccgcugauguggggugcagcgucgacuuuucuaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6764 - RNA, 2524 nt, Artificial Sequence
  KY288905.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugauacaggacacgaaaccgacgagaacagagccaagguggaggucaccccuaauagcccgcgcgcugaagcgacacuuggcggcuucgggucccugggacucgauugugagccccggaccggccuggacuuuucugaucuuuacuaucugacaaugaacaauaaacauuggcucgugcacaaggaaugguuccacgacaucccucugcccuggcaugccggggcugauacgggaaccccucacuggaacaauaaagaggcccugguugaauuuaaggacgcccaugcuaagagacagacaguggucgugcucggcagccaggagggggccguucacaccgcgcuggcuggcgcccuugaggccgaaauggauggagcuaaaggccgccuguucuccgggcaucucaagugccggcugaaaauggacaaacuuagacugaaaggagugagcuacucucucuguacagccgcuuuuaccuucacgaagguccccgccgagacccugcacggcacagugaccguggaaguucaguaugcggggacagacggaccgugcaaggucccugcccaaauggcuguggauaugcagacccugacgcccgugggccgccucauuacagccaacccugucaucaccgaguccacagaaaacagcaaaaugaugcuggagcuugacccucccuuuggggauucuuacaucgugauuggcguuggagacaagaaaaucacccaccauuggcaccgguccggcagcaccauugggaaggcuuucgaggccacagugagaggagcgaaacgcauggccguccugggcgauacggcuugggacuucggguccgugggaggcguuuuuaauucucucgggaagggcauccaucagauuuucggagccgcuuuuaagagccuguucggcgggauguccugguuuucucaaauccugaucggaacccuucucguguggcugggccugaacacaaagaaugggagcauuucccucaccugucuggcccuuggaggcgucaugaucuuccugagcacagccgugucugcugauguugggugcuccguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6765 - RNA, 2524 nt, Artificial Sequence
  KF268950.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgauauuggacacgaaaccgacgagaauagagcgaagguggaggucacgccuaacagcccgcgcgccgaagcuacacuuggcggcuucgggucccugggacucgauugugagccccggaccggccuggacuuuucugaucuuuacuaucugaccaugaauaacaaacauuggcucgugcacaaggaaugguuccacgacaucccucugcccuggcaugccggggccgauacaggaaccccucacuggaauaacaaagaggcucuggucgaauuuaaggacgcccaugcgaagagacagacagugguugugcucggcagccaggagggggcuguccacacggcccuggccggcgcucuugaggccgaaauggauggagcuaaaggccgccuguucuccgggcaucucaagugccggcugaaaauggacaaacuuagacugaaaggagugagcuacucucucuguaccgccgcguuuacauucaccaagguucccgccgagacacugcacggcaccgugacggucgaagugcaguaugcugggaccgacggaccgugcaaggugccugcccaaauggcuguugauaugcagacacugacccccgucggccgccucaucacagccaacccugugauuaccgaguccacggaaaauagcaaaaugaugcuggagcuugacccucccuuuggggauucuuacaucgugauuggcgucggagacaagaaaaucacacaccauuggcaccgguccggcagcaccauugggaaggcguucgaggccacagugagaggagcuaaacgcauggccguucugggcgauaccgcuugggacuucggguccgugggaggcgucuuuaacucucucgggaagggcgugcaucagaucuucggagccgccuuuaagagccuguucggcgggauguccugguuuucucaaauccugauuggaacccuucucguuuggcugggccugaauacaaagaacgggagcaucucccucacgugucuggcucuuggaggcgugaugauuuuccugagcaccgcggucucugccgauguggggugcuccguugacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6766 - RNA, 2524 nt, Artificial Sequence
  KF383121.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauauuggacacgaaacggacgagaacagagcuaaggucgaggugacaccuaauagcccgcgcgcggaagccacccuuggcggcuucgggucccugggacucgauugugagccccggaccggccuggacuuuucugaucuuuacuaucugacaaugaacaauaaacauuggcucguccacaaggaaugguuccacgacaucccucugcccuggcaugcuggggccgauaccggaacaccucacuggaacaauaaagaggcccugguggaauuuaaggacgcucaugccaagagacagacgguugugguccucggcagccaggagggggcggugcacaccgcucuggccggcgcccuugaggcugaaauggauggagccaaaggccgccuguucuccgggcaucucaagugccggcugaaaauggacaaacuuagacugaagggaguuagcuacucucucuguacagcugccuuuaccuucacaaaggugcccgcggagacccugcacggcacggucaccguggaagugcaguaugccgggacagacggaccgugcaagguuccugcucaaauggccgucgauaugcagacccugacacccgugggccgccucaucaccgcuaacccugugauuacggaguccacagaaaacagcaaaaugaugcuggagcuugacccucccuuuggggauucuuacaucgucauuggcgugggagacaagaaaaucacccaccauuggcaccgguccggcagcacaauugggaaggccuucgaggcgaccguuagaggagccaaacgcauggcugugcugggcgauaccgccugggacuucggguccgucggaggcguguuuaauucucucgggaagggcauccaucagaucuucggagcugccuuuaagagccuguucggcgggauguccugguuuucucaaauucugaucggaacacuucucguuuggcugggccugaacacgaaaaaugggagcauuucccucaccugucuggcccuuggaggcgugaugaucuuccugagcacagcugucucugcggauguggggugcuccguugacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6767 - RNA, 2506 nt, Artificial Sequence
  KF268949.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgaugaaaauagagcgaagguggaggucaccccuaacagcccgcgcgccgaggcuacgcuuggaggcuucggcucccuggggcucgacugugaaccccggacaggacuggauuuuucugaccuuuacuaucugaccaugaauaacaaacacuggcucgugcauaaggagugguuccacgauauuccucugcccuggcacgccggcgccgacaccgggacaccucauuggaauaacaaagaagcucuggucgaguuuaaggaugcccacgcgaagagacagaccgugguugugcucggaagccaggaaggcgcuguccauacagcccuggccggggcucuugaggccgagauggacggcgcuaaaggacgccuguucuccggccaccucaagugccggcugaaaauggauaaacuuagacugaagggggugagcuacucucucuguacggccgcguuuaccuucacaaagguucccgccgaaacccugcauggaacagugaccgucgaggugcaguaugcuggcacggacgggccgugcaaggugccugcccaaauggcuguugacaugcagacccugacacccgucggacgccucaucaccgccaacccugugaucacagaauccaccgagaauagcaaaaugaugcuggaacuugauccucccuuuggcgacucuuacauugugaucggggucggcgauaagaaaauuacgcaccacuggcaucgguccggaagcacaaucggcaaggcguucgaggccaccgugagaggggcuaaacgcauggccguucugggagacacagcuugggauuucggcuccgucgggggaguguuuaacucucucggcaaggggauucaccagaucuucggcgccgccuuuaagagccuguucggaggcauguccugguuuucucaaauccugauugggacccuucucguguggcugggacugaauaccaaaaacggcagcaucucccucacaugucuggcucuugggggaguuaugauuuuccugagcacggcggugucugccgacgucggcugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6768 - RNA, 2524 nt, Artificial Sequence
  KU955595.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugauacgggacacgaaacagacgagaacagagcuaagguggaggucaccccuaauagcccgcgcgcggaagccacccuuggcggcuucgggucccugggacucgauugugagccccggacaggccuggacuuuucugaucuuuacuaucugaccaugaacaauaaacauuggcucgugcacaaggaaugguuccacgacaucccucugcccuggcaugcuggggccgauacaggaacgccucacuggaacaauaaagaggcccugguugaauuuaaggacgcucaugccaagagacagaccguggucgugcucggcagccaggagggggcgguucacacagcucuggccggcgcccuugaggcugaaauggauggagccaaaggccgccuguucuccgggcaucucaagugccggcugaaaauggacaaacuuagacugaagggagugagcuacucucucuguaccgcugccuuuacauucaccaagguccccgcggagacgcugcacggcaccgugacaguggaaguucaguaugccgggaccgacggaccgugcaaggucccugcucaaauggccguggauaugcagacacugacccccgugggccgccucauuacggcuaacccugucaucacagaguccaccgaaaacagcaaaaugaugcuggagcuugacccucccuuuggggauucuuacaucgugauuggcguuggagacaagaaaaucacacaccauuggcaccgguccggcagcaccauugggaaggccuucgaggcgaccgugagaggagccaaacgcauggcuguccugggcgauacagccugggacuucggguccgugggaggcguuuuuaauucucucgggaagggcauccaucagauuuucggagcugccuuuaagagccuguucggcgggauguccugguuuucucaaauccugaucggaacgcuucucguguggcugggccugaacaccaaaaaugggagcauuucccucacaugucuggcccuuggaggcgucaugaucuuccugagcaccgcugugucugcggauguugggugcuccguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6769 - RNA, 2524 nt, Artificial Sequence
  KF383116.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaacacaagaaaggcgaagcccgcagaagccggcgcgcgguuacccuuccgucccauucuacaagaaagcugcagacccggagccagacauggcucgagucccgcgaguauaccaagcaccugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacauggcgggugugugaccgugauggcccaagauaaacccacagucgacaucgagcuugugaccaccacaguuagcaacauggcugaggugagaucuuacugcuacgaagccuccaucagcgauauggcuuccgacucucgguguccuacgcagggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucaacccgaaaaccucgaguaucggaucaugcuguccgugcacggcagccagcacucugggaugauugucaaugauaucggacaugaaacggacgagaacagagcuaagguggaggucacaccuaauagcccgcgcgcggaagccacccuuggcggcuucgggucccugggacucgauugugagccccggaccggccuggacuuuucugaucuuuacuaucugacaaugaacaauaaacacuggcucgugcauaaggaaugguuccacgacauuccucugcccuggcacgcuggggccgauaccggaacaccucauuggaacaauaaagaggcccugguugaauuuaaggacgcucacgccaagagacagacgguggucgugcucggcagccaggagggggcgguucauaccgcucuggccggcgcccuugaggcugaaauggauggagccaaaggccgccuguucuccgggcaccucaagugccggcugaaaauggacaaacuuagacugaaaggagugagcuacucucucuguacagcugucugcaccgccgcgaaggugcccgccgagacacugcauggcaccgugacgguugaaguccaauaugcugggaccgacggaccguguaaggugccugcccagauggcuguggauaugcagacacugacccccgucggccgccucaucacagccaacccugugaucaccgaguccacggaaaacagcaaaaugaugcuggagcuugacccucccuuuggggauucuuacauuguuaucggcgugggagacaagaaaauuacacaccacuggcaucgguccggcagcaccaucgggaaggcguucgaggccacagucagaggagcuaaacgcauggccgugcugggcgauaccgcuugggacuuuggguccguuggaggcguguucaauucucucgggaagggcauucaccaaaucuucggagccgccuuuaagagccuguucggcgggauguccugguuuucucagauccugauuggaacccuucucgucuggcugggccugaacacaaagaaugggagcaucucccucacgugccuggcucuuggaggcgugaugauuuuccugagcaccgcgguuucugccgaugugggguguuccgucgacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6770 - RNA, 2506 nt, Artificial Sequence
  KU963574.2 prME-long mRNA Design 2 opt
ggggcgcugccuacggagguggcagccaucuccuucucggcaucaagcuuaccaugagaaucauuaacgcccggaaggagcgcaaaagacggggcgcugacgccagcaucgggauugugucccugcuccugaccacagucauggcggcugaaaucacgcgcagaggaucugccuacuauauguaccuugaucggagcgacgccggcaaggcuauuuccuucguuaccacacugggggugaauaaaugccacgugcagaucauggaucucggacauaugugugacgccaccaugucuuaugagugccccaugcuggaugaaggcgucgagcccgacgauguggacuguuggugcaacacaaccagcacauggguuguguacgggaccugucaccauaagaaaggagaagcucgcagaucccggcgcgccgucacgcuuccgucucacagcaccagaaagcugcaaacacggucccagaccuggcucgagagccgcgaguauacaaagcaucugaucaaaguggaaaauuggauuuuuagaaaccccggcuucgcgcugguugccguggcuaucgccuggcuccugggaucuuccaccagccagaaggucauuuaccuugugaugauccugcucauugcuccugccuauucuauccggugcauugggguguccaaucgcgauuuugucgagggaaugagcggcgggacguggguugacguggugcuggaacacggaggcugugucacagugauggcgcaggauaaacccaccguugacaucgagcuugugacaaccaccgucucuaacauggccgaggugagauccuacugcuacgaagcuagcaucuccgauauggccucugacagccgguguccuacacaaggggaggcuuaucuggacaagcaguccgauacgcaguacguuugcaaaagaacccucguggaccgcggauggggcaauggcugugggcuguucggaaagggcagccuggucacaugcgccaaguuuaccugcucuaaaaagaugacagggaaauccauucagcccgaaaaccucgaguaucggaucaugcugagcgugcacggaucucaacauagcggcaugauugucaaugaugaaaacagagccaagguggagguuaccccuaauuccccgcgcgcugaggcgacgcuugggggauucggcucucugggccucgacugugaaccccggacagggcuggauuuuagcgaccuuuacuaucugaccaugaacaauaaacacuggcucgugcauaaggagugguuccacgauaucccucugcccuggcacuccggagccgacaccgaaacaccucauuggaacaauaaagaggcucuggucgaauuuaaggaugcccacgccaagagacagaccgugguugugcucggcagccaggagggggcuguccauacagcccuggcgggagcucuugaggccgaaauggacggcgccaaagggcgccugucuuccggccaccucaagugccggcugaaaauggauaaacuuagacugaaaggagugagcuacucucucuguacggcugccuucaccuuuacaaaggugcccgcugagacccugcauggcacaguuaccgucgaagugcaguaugccgggcgcgacggaccgugcaaggugccugcgcaaauggccgucgacaugcagacgcugacccccgugggccggcucauuacagcuaacccuguuaucaccgaguccacagaaaacagcaaaaugaugcuggagcuugauccucccuucggggacuccuacaucgugauuggagucggcgauaagaaaaucacccaccacuggcauagaucugggagcauuaucggcaaggccuuugaggcuacggugcgcggagccaaacggauggcgguucugggcgacacagccugggauuucggguccgugggaggcgucuucaauucucucgggaagggcauucaccagaucuuuggcgcugccuucaagagccuguuugggggcauguccugguucagccaaauccugauuggaacccuucucguguggcugggccugaacacaaagaaugggucuaucucccucaccugucuggcucuuggaggcguuaugauuuuucugagcaccgccgugucugccgacgucgggugcuccguggauuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6771 - RNA, 2506 nt, Artificial Sequence
  KX601166.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugaugaaaacagagcuaagguggaggucacgccuaauagcccgcgcgcggaggccacacuuggaggcuucggcucccuggggcucgacugugaaccccggaccggacuggauuuuucugaccuuuacuaucugaccaugaacaauaaacacuggcucgugcauaaggagugguuccacgauaucccucugcccuggcacgcuggcgccgacacagggaccccucauuggaacaauaaagaagcccugguugaguuuaaggaugcucacgccaagagacagacaguggucgugcucggaagccaggaaggcgcgguucauacggcucuggccggggcccuugaggcugagauggacggcgccaaaggacgccuguucuccggccaccucaagugccggcugaaaauggauaaacuuagacugaaaggggugagcuacucucucuguaccgcugccuuuacauucaccaagguccccgcggaaacacugcauggaaccgugacgguggagguucaguaugccggcaccgacgggccgugcaaggucccugcucaaauggccguggacaugcagacacugacccccgugggacgccucauuacagcuaacccugucaucaccgaauccacggagaacagcaaaaugaugcuggaacuugauccucccuuuggcgacucuuacaucgugauugggguuggcgauaagaaaaucacacaccacuggcaucgguccggaagcaccauuggcaaggccuucgaggcgacagugagaggggccaaacgcauggcuguccugggagacaccgccugggauuucggcuccguugggggaguguuuaauucucucggcaaggggauccaccagauuuucggcgcugccuuuaagagccuguucggaggcauguccugguuuucucaaauccugaucgggacccuucucguguggcugggacugaacacaaagaauggcagcauuucccucacgugucuggcccuugggggagucaugaucuuccugagcaccgcugugucugcggacguuggcugcuccguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6772 - RNA, 2524 nt, Artificial Sequence
  KF383118.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagccugacgauguggacuguuggugcaacaccacaucuaccuggguggucuacggaacgugucaccauaagaaaggcgaaacccgcagaagccggcgcuccgugucucuuagauaucacuacacacggaagcugcaaacccgcagccagacauggcucgaguccagagaguauaagaaacaucugauuaugguugaaaauuggaucuuucggaacccgggcuucgccauugugagcgucgcgaucaccuggcugauggggucucucacgucccagaaggugauuuaccugguuaugaucgugcuuauuguccccgccuacagcaucucuugcaucggaguguccaaucgcgaucugguggagggcaugagcgggggaacaugggucgacguugugcucgaacacggcgggugugugaccgagauggcucaggauaaaccuacagucgacauugagcuggugaccaugaccguuucuaacauggccgaagugagauccuauugcuacgaggcuagccuuuccgauauggccucugcgagccggugucccacacaaggagaaccuucccuggacaagcagagcgacacgcagucugucugcaaaagaacccucggcgaucgcggcugggggaauggauguggcaucuuugggaagggaucccuggugacaugcagcaaguuuaccugcuguaaaaagaugcccggcaaaucuauucagccugagaaccuggaauaucggaucaugcucccgguucacgggagccaacauuccggaaugauugugaaugacaucggccacgagacagaugagaacagagccaaggucgaagugacccccaauucuccucgcgcugaggccacgcugggcggguuuggaagccuuggccuggacugcgaaccccggacagggcucgauuucuccgaccuguacuaucuuaccaugaacaauaaacauuggcugguccacaaggagugguuucacgauaucccucuccccuggcaugcuggagccgacaccggcacaccgcacuggaacaauaaagaagcccugguggaguucaaggaugcucaugcgaagagacagaccguugugguccuggggagccaggagggcgccgugcacacagcucucgccggagcccuggaagcugagauggacggcgccaaagggcgccuuuucucuggacaucugaagugucggcucaaaauggauaagcugagacuuaaaggcguuuccuacagccugugcacggcggcuuucaccuuuacaaaggugccugccgaaacccuccacgggacagucaccguggaggugcagucugccggaacggacggccccuguaagguuccugcucaaauggccgucgacaugcagacccugacacccguggggcgccugauuaccgcuaaccccgugaucacagaauccaccgagaacagcaaaaugaugcucgagcuggauccuccguucggcgacuccuauauugucaucggagugggcgauaagaaaauuacgcaccauuggcaccggucugggagcacaaucggaaaggccuuugaagcgaccguuagaggcgccaaacgcauggcugugcuuggggacacagccugggauuucggauccgucggcgggguguucaauucucugggcaagggaauccaucagauuuuuggcgcugccuucaagagccucuuugggggaauguccugguucagccaaauccugauuggcacccugcuuguuuggcucgggcugaacaccaaaaauggaucuaucucccugacaugccucgcgcugggcggggugaugauuuuucuuagcacggccgucucugcugacgugggcuguuccguugauuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6773 - RNA, 2518 nt, Artificial Sequence
  KF383120.1 prME-long mRNA Design 2 opt
ggggcgcugccuacggagguggcagccaucuccuucucggcaucaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaccaugggagugaauaaaugccacguccagaucauggaucugggccauaugugugacgcuacaauguccuaugagugccccaugcucgaugaagggguugagccugacgauguggacuguuggugcaacaccacaucuaccuggguggucuacggaacgugucaccauaagaaaggcgaagcccgcccgagcagacgggcggugacccugcccucccacucuacacgcaaacuucaaaccagaagccagacauggcuggagucccgggaguauaccaagcaucucauuaagguugaaaauuggauccugcgcaacccuggcuuuacgguggccgcucuggccauggcuuggcuccuggggaauagcacaucucagagagucauuuaccuugugaugauccugcucauugcccccgcguauuccauccggugcauuggaguuagcaaccgcgauuucguggagggcaugucugggggaaccugggucgacguggugcuggaacacggcgggugugucacaguuauggcccaggauaagccuaccguggacaucgagcuugugaccacaacggucuccaauauggcugaggugagaagcuacugcuacgaagccucuaucuccgauauggcuagcgacucccggugucccacccaaggagaggccuaucuggacaaacagucugauacacaguacguuugcaagagaacccucguggaccgcggcuggggcaacggguguggacuguuuggcaaagggagccuggucacaugcgccaaguuuaccugcuccaagaaaaugacgggaaagagcauucagccugaaaaucucgaguaucggaucaugcugucugugcacggcucccaacauagcgggaugauuguuaacgauaucggacacgaaacagacgagaauagagcuaaaguggaggucaccccgaacucuccccgcgcggaagccacccuuggcggcuucgggagccugggacucgauugugagccucggacaggccuggacuucuccgaucuuuacuaucugaccaugaauaacaagcauuggcucgugcacaaagaaugguuucacgacauuccccugccuuggcaugcuggggccgauacaggaacgccccacuggaauaacaaggaggcccuggucgaguucaaagacgcucaugccaagagacagaccgugguugugcucggcucucaggaaggggcgguccacacagcucuggccggcgcccuugaggcugaaauggauggagccaagggccgccuguuuagcgggcaucucaaaugccggaucaagauggacaaacugagacuuaagggaguguccuacagccuguguaccgcugccuucacauuuucuaaaguuccggcggagacccuccacggcacggugaccgucgaagugcaguaugccgggcgcgacggaccuugcaaggugcccgcucaaauggccguugauaugcagacacugaccccugucggccggcugaucacagcuaaccccauuaucaccgaguccacggaaaauagcagaaugaugcucgagcuggaucccccuuucggggacucuuacauugugaucggcgugggagacaagaaaauuacacaccauuggcaccgcuccggcagcaccaucgggaaggccuuugaggcgacaguccggggagccaaaagaauggcugugcuuggcgauaccgccugggacuucggguccguuggaggcguguucaacucucuggggaagggcguccaucagguguuuggagcugccuucaaaagccucuuuggcgggauguccugguucucucaaauccugauuggaacccugcuuguuuggcucggccugaauacaaagaacgggagcaucucccuggccugucucgcucugggaggcgcgaugauuuuucuuagcacggccgugucugcugaugucgggugcuccguggacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6774 - RNA, 2449 nt, Artificial Sequence; identical to SEQ ID NO: 6609
  KU321639.1 prME-short mRNA Design 2 opt

SEQ ID NO: 6775 - RNA, 2449 nt, Artificial Sequence; identical to SEQ ID NO: 6610
  KU312312.1 prME-short mRNA Design 2 opt

SEQ ID NO: 6776 - RNA, 2437 nt, Artificial Sequence; identical to SEQ ID NO: 6611
  AY632535.2 prME-short mRNA Design 2 opt

SEQ ID NO: 6777 - RNA, 2449 nt, Artificial Sequence; identical to SEQ ID NO: 6612
  KU527068.1 prME-short mRNA Design 2 opt

SEQ ID NO: 6778 - RNA, 2449 nt, Artificial Sequence
  KX421193.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacacgggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6779 - RNA, 2449 nt, Artificial Sequence
  KX377335.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucacagaaagaaaggagaggcccggcgcagcagacgggcugugacccuuccgucccauucuacacgcaagcugcaaaccagaagccagacauggcucgaaucccgggaguauaccaaacaccugaucaagguugagaacuggaucuuucgcaaucccggcuucgcccugguggcggucgccauugcuuggcuccugggcagcucuacgucccagaaggugaucuaccuuguuaugauucugcucaucgccccugcuuauagcauuagaugcaucggggugucuaaccgggacuuugucgaaggaauguccggcgggacauggguggaugugguccuggagcauggaggcuguguuaccgugauggcccaggacaaacccacaguggauauugaacuugucaccaccacagugagcaauauggcggagguucgcucuuacugcuacgaggccuccaucagcgacauggcuuccgauucuagauguccuacgcaaggggaagccuaucuggacaagcagagcgacacccaguacgugugcaaacggacacucgucgaucgcggauggggcaacggcugugggcuguucggaaagggcucccuggugaccugcgcuaaauuuacaugcagcaagaagaugaccgggaaaucuauccagcccgagaaucucgaauauagaauuaugcuguccguucacggaagccaacacucuggcaugaucgugaacgacacgggguacgagacagaugaaaaucgggccaaggucgaggugaccccuaacagcccgagagccgaggcuacccuuggaggcuucggcucccuggggcucgacugugaaccccgcacaggacuggauuuuucugaccuuuauuaccugaccaugaauaacaaacauuggcucguccacaaggagugguuccaugauauuccucugcccuggcacgcgggcgccgacacagggacgccucacuggaauaacaaagaagcucugguggaguuuaaggaugcccaugccaaacggcagaccguugugguccucggaagccaggaaggcgcugugcacacagcccuggcgggggcucuugaggccgagauggacggcgccaagggaaagcuguucuccggccaucucaaaugcagacugaagauggauaaacuucgccugaaggggguuagcuauucucucuguaccgcugccuuuacauucaccaaagugcccgcugaaacgcugcacggaaccgucacaguggaggugcaguacgccggcaccgacgggccgugcaagaucccuguucaaauggcggucgacaugcagacacugacccccgugggacggcucauuacggccaauccugugaucacagaauccaccgagaacagcaagaugaugcuggaacuugauccucccuuuggcgacucuuacaucgucauuggggugggcgauaaaaagaucacacaucacuggcacagauccggaagcaccauuggcaaggcuuucgaggccaccguucgcggggcuaaacggauggccgugcugggagacacagcgugggauuucggcuccgucgggggaguguuuaacucucucggcaaagggauccaucagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6780 - RNA, 2449 nt, Artificial Sequence
  LC002520.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugacggugaacgacaucggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6781 - RNA, 2431 nt, Artificial Sequence
  DQ859059.1 prME-short mRNA Design 2 opt
ggggcgcugccuacggagguggcagccaucuccuucucggcaucaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacgagaauagagcuaagguggaagucacaccuaacagcccgcgggccgaggccacccuugggggauucggcucccugggccucgauugugagcccagaaccgggcuggacuuuucugaucuuuacuaucugacaaugaauaacaaacacuggcucgugcauaaggaaugguuccacgacaucccucugcccuggcacgcuggagcggauaccggcacaccucauuggaauaacaaagaggcccugguugaauuuaaggacgcucacgccaaacgccagacgguggucgugcucgggagccaggagggagccguucauaccgcucuggccggcgcgcuugaagcugagauggauggggccaagggccggcuguucuccggacaccucaagugcagacugaaaauggacaaacuucgccugaagggcgugagcuacucucucuguacagccgcuuuuaccuucacaaagguccccgccgagacccugcaugggacggugaccguggaaguucaguaugcuggaacagauggcccgugcaaagucccugcccaaauggcgguggacaugcagacccugacacccguggggcggcucauuaccgccaauccugucaucacggaguccacagaaaacagcaagaugaugcuggagcuugacccucccuuuggagauucuuacauugugaucggcguuggggacaagaaaaucacccaccacuggcauagauccggcagcacaauuggaaaggcuuucgaagccaccgugcgcggcgcuaaacggauggccguccugggggauaccgcgugggacuucggauccgugggcgggguuuuuaacucucucggaaagggcauccaccagauuuucggggccgcuuuuaaaagccuguucggcggaauguccugguuuucucaaauccugauuggcacacuucucguguggcuggggcugaauacgaagaacggaagcaucucccucaccugucuggcccuuggcggggucaugaucuuccugagcacagcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6782 - RNA, 2437 nt, Artificial Sequence
  KU963573.2 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaaaacagagccaagguggaggucacaccuaauagcccgcgggccgaggcuacccuuggaggcuucggcucccuggggcucgauugugaacccagaaccggacuggacuuuucugaucuuuauuaccugacaaugaacaauaaacacuggcucgugcauaaggagugguuccacgacauuccucugcccuggcacgcgggcgccgauaccgggacaccucauuggaacaauaaagaagcucuggucgaguuuaaggacgcccacgccaaacgccagacggugguugugcucggaagccaggaaggcgcuguccauaccgcccuggcgggggcucuugaggccgagauggauggcgccaagggaaagcuguucuccggccaccucaaaugccggcugaagauggacaaacuuagacugaagggggugagcuauucucucuguacagcugccuuuaccuucacaaaaguucccgcugaaacccugcauggaacggugaccgucgaggugcaguacgccggcacagaugggccgugcaagaucccugugcaaauggcgguugacaugcagacccugacacccgucggacgccucauuaccgccaacccugugaucacggaauccacagagaauagcaagaugaugcuggaacuugacccucccuuuggcgauucuuacaucgugauuggggucggcgacaaaaagaucacccaccacuggcaucgguccggaagcacaauuggcaaggcuuucgaggccaccgugagaggggcuaaacgcauggccguucugggagauaccgcgugggacuucggcuccgucgggggaguguuuaacucucucggcaaagggauccaccagauuuucggcgccgcuuuuaagagccuguucggaggcauguccugguuuucucaaauccugaucgggacacuucucguguggcugggacugaacacgaagaauggcagcauuucccucaccugucuggcccuugggggaguuaugaucuuccugagcacagcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6783 - RNA, 2449 nt, Artificial Sequence
  KX694534.2 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggccgcgggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6784 - RNA, 2449 nt, Artificial Sequence
  KX369547.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggccuggcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucugugcacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucggggugggcgagaaaaagauuacccaccacuggcaucgcuccggaagcacaaucggcaaggccuucgaagcgaccgugagaggggccaaacggauggcuguccucggagauaccgccugggacuuuggcuccgucgggggagcucuuaauucucugggcaaggggauucaccagaucuucggcgccgccuucaaaagccuguuuggaggcauguccugguucucucaaauucucaucgggacacugcugauguggcucggacugaacacgaagaauggcagcaucucccuuaugugucuggcucucgggggaguucugauuuuucugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6785 - RNA, 2449 nt, Artificial Sequence
  KX447515.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacugguaucgcuccggaagcacaaucggcaaggccuuugaagcgaccgugagaggggccaaacggauggcuguccugggagauaccgccugggacuucggcuccgucgggggagcucucaauucucugggcaaggggauucaucagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6786 - RNA, 2449 nt, Artificial Sequence
  KU729218.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacacccagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccgucgggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggaguucucauuuuccugagcacagcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6787 - RNA, 2449 nt, Artificial Sequence
  KU501217.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgagauccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6788 - RNA, 2449 nt, Artificial Sequence
  KU312314.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccuggcucaaauggccguggacaugcagacccucacacccgugggaagacugaucaccgcuaacccuguuauuacggaguccacagaaaacagcaagaugaugcuugagcuggauccgcccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6789 - RNA, 2449 nt, Artificial Sequence
  KX446950.2 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuacccuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggagugcucauuuuccugagcacagcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6790 - RNA, 2449 nt, Artificial Sequence
  KY003157.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccguggucucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6791 - RNA, 2449 nt, Artificial Sequence
  KX811222.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccgcuugggucguguaugggaccugucaucacaaaaagggagaagccagacggucucgcagagcuguuacgcuucccagccauuccacccggaaacugcaaacacgcccucagaccuggcucgagucuagagaguacacaaagcaccugauccggguggaaaauuggauuuuucgcaaccccggcuucgcccuggcggccgcugccaucgcuuggcuccugggcagcuccaccagccagaaagucaucuaucuugugaugauucugcucaucgccccugcguacucuauuagaugcaucgggguuuccaaucgggacuuuguggagggaaugagcggcgggacgugggucgauguggugcuggaacauggaggcugugucacaguuauggcccaggacaagcccaccguggauauugagcuugugacaaccaccgucucuaacauggcugaggugcgcuccuacugcuaugaagccagcaucucugacauggcuuccgauagcagauguccuacacaaggggaggccuaccuggacaagcaguccgacacgcaguauguuugcaaacggacccucguggaucgcggauggggcaauggcugugggcuguucggaaagggcucucuggucacaugcgccaaauuugcuugcagcaagaaaaugaccgggaaguccauucagccggaaaaccucgaguacagaaucaugcugagcgugcacggaucucaacacuccggcaugaucguuaaugacacagggcaugaaaccgaugagaaccgggcgaagguggagauuacgcccaauagcccuagagccgaagcuacacuuggaggcuucggcucucuggggcucgacugugagccccgcaccggacuggauuuuagcgaccuuuauuaccugaccaugaacaauaaacacuggcucguccauaaggaaugguuccacgauaucccucugcccuggcacgccggcgccgacacagggaccccgcauuggaacaauaaagaggcucugguggaauuuaaggaugcccacgcgaaacggcagacagucgugguucucggaucccaggagggcgcugugcauacggcccuggccggggcucuugaggccgaaauggacggcgcuaagggaagacugucuagcggccaccucaaaugccgccugaagauggauaagcugcggcugaaaggggucuccuauagccucuguaccgccgcguucacauuuaccaagauuccugccgagacacugcauggaaccgugacgguugaagugcaguacgcuggcaccgacgggcccugcaaagucccugcccaaauggcuguggacaugcagacacugacccccgugggaagacucaucacagccaaccccguuauuaccgagucuacggaaaacuccaagaugaugcuggagcuugauccuccguucggcgacagcuacaucgucaucggggugggcgagaaaaagauuacacaccacuggcaucgcucuggauccaccaucggcaaggcguuugaagccacagugagaggggcuaaacggauggccguccugggagauaccgcuugggacuucggcagcguugggggagcccucaauucccugggcaaggggauucaccagaucuucggcgccgcuuuuaaaucucuguucggaggcaugagcugguuuucccaaauucuuaucgggacccuccugauguggcugggacucaacacaaagaauggcucuaucagccugaugugucuugcgcuugggggagugcucauuuuccuguccacggccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6792 - RNA, 2449 nt, Artificial Sequence
  KX447516.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucuaaaaaggucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcagggggaggcuuaccuggacaaacaaucugacacccaguauguuugcaagcggacacucguggaucgcggauggggcaauggcugugggcuguucggaaaaggcagccuggugaccugcgccaaguuugccugcuccaaaaagaugacagggaagucuauucagccugaaaaccucgaguacagaaucaugcugucugugcacggaucccagcacagcggcaugaucguuaaugacaccgggcaugaaacggaugagaaccgggcuaaaguggagauuacacccaauucuccgagagcggaagccacccuuggaggcuucggcagccuggggcucgacugugagccucgcaccggacuggauuuuuccgaccuuuauuaccugacaaugaacaauaagcacuggcucguccauaaagaaugguuccacgauaucccccugccuuggcacgcuggcgccgacaccgggacaccccauuggaacaauaaggaggcccugguggaauuuaaagaugcucacgccaagcggcaaacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucagauggccguggacaugcaaacccugacaccugugggaagacucaucaccgcuaaccccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaauucucugggcaaagggauucaccagaucuucggcgccgccuuuaagagccuguucggaggcauguccugguuuucucagauucuuaucgggacacuccugauguggcugggacucaacacgaaaaauggcagcaucucccugaugugucuugcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6793 - RNA, 2449 nt, Artificial Sequence
  KX520666.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgagacagaaagucaucuaucuugugaugauucugcucaucgcucccgccuacucuauucggugcaucgggguuuccaaucgcgacuuuguggagggaaugagcggcgggacaugggucgauguggugcuggaacauggaggcugugucaccguuauggcgcaggacaagccuacaguggauauugagcuugugaccaccacagucucuaacauggccgaggugagauccuacugcuaugaagcuagcaucucugacauggccuccgauagccggugucccacgcaaggggaggcuuaccuggacaagcaguccgacacccaguauguuugcaaacgcacacucguggauagaggauggggcaauggcugugggcuguucggaaagggcucucuggugaccugcgccaaauuugccugcagcaagaaaaugacagggaaguccauucagccugaaaaccucgaguaccggaucaugcugagcgugcacggaucucaacacuccggcaugaucguuaaugacaccgggcaugaaacggaugagaacagagcuaagguggagauuacaccgaauagcccccgcgcggaagccacccuuggaggcuucggcucucuggggcucgacugugagccucggaccggacuggauuuuagcgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaaagacagacggucgugguucucggaucccaggagggcgcggugcauaccgcucuggccggggcccuugaggcugaaauggacggcgccaagggacgccugucuagcggccaccucaaaugccggcugaagauggauaagcugagacugaaaggggucuccuauagccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggacgccucaucaccgcuaaccccguuauuacggagucuacagaaaacuccaagaugaugcuggagcuugaucccccuuucggcgacagcuacaucgucaucggggugggcgagaaaaagauuacccaccacuggcaucggucuggauccacaaucggcaaggccuuugaagcgaccgugagaggggccaaacgcauggcuguccugggagauaccgccugggacuucggcagcgucgggggagcucucaauucccugggcaaggggauucaccagaucuucggcgccgccuuuaaaucucuguucggaggcaugagcugguuuucccaaauucuuaucgggacacuccugauguggcugggacucaacacgaagaauggcucuaucagccugaugugucuugcucuugggggaguucucauuuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6794 - RNA, 2449 nt, Artificial Sequence
  KU497555.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaacccaggagggcgcggugcauacagcucuggccggggcccuugaggcugaaauggacggcgccaagggaagacugucuagcggccaccucaaaugccgccugaagauggauaagcugcggcugaaaggggucuccuauagccucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagucuaccgaaaacuccaagaugaugcuggagcuugaucccccuuucggcgacagcuacaucgucaucggggugggcgagaaaaagauuacacaccacuggcaucgcucuggauccaccaucggcaaggccuuugaagcgaccgugagaggggccaaacggauggcuguccugggagauacagccugggacuucggcagcgucgggggagcucucaauucccugggcaaggggauucaccagaucuucggcgccgccuuuaaaucucuguucggaggcaugagcugguuuucccaaauucuuaucgggacgcuccugauguggcugggacucaacaccaagaauggcucuaucagccugaugugucuugcucuugggggaguucucauuuuccuguccacagcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6795 - RNA, 2449 nt, Artificial Sequence
  KY075939.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacucccugagaugcauugggguuagcaaucgggacuuuguggagggaaugucuggcgggacaugggucgauguggugcuugaacauggaggcugugucaccguuauggcgcaggacaagccuacaguggauaucgagcuggugaccaccacagucuccaacauggccgaggugcgcagcuacugcuaugaagcuagcauuuccgacauggccagcgauuccagaugucccacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauccagccugaaaaccuggaguacagaauuaugcuuucugugcacggaucccaacacagcggcaugaucguuaaugacaccgggcaugaaacggaugagaaccgggcuaagguggagaucacacccaauucuccgagagcggaagccacccugggaggcuucggcagccucgggcuggacugugagccucgcaccggacuugauuuuuccgaccuguauuaccucacaaugaacaauaaacacuggcugguccauaaggaaugguuccacgauauuccccugccuuggcacgcuggcgccgacaccgggacaccccauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagaucccggcggagacccugcauggaacggugaccguugaagugcaguacgccggcacagacgggccuugcaaaguccccgcucaaauggccguggacaugcagacccucacaccugugggaagacugauuaccgcuaaccccguuaucacggaguccacagaaaacagcaagaugaugcuugagcuggaucccccuuucggcgacucuuacauugucaucggggugggcgagaaaaagaucacccaccacuggcaucgcuccggaagcacaauuggcaaggccuuugaagcgaccgugagaggggccaaacggauggcuguccucggagauaccgccugggacuucggcuccgucgggggagcucuuaauucucugggcaaggggauccaccagauuuucggcgccgccuuuaaaagccuguucggaggcauguccugguuuucucaaauccucauugggacacugcugauguggcucggacugaacacgaagaauggcagcaucucccuuaugugucuggcucucgggggaguucugaucuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6796 - RNA, 2449 nt, Artificial Sequence
  KY075932.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggauugaaaauuggaucuuucgcaacccuggcuucgcucuggccgcggccgcuaucgccuggcuccugggcuccagcacgucucagaaagugauuuaucuugucaugauccugcucauugcucccgccuacuccaucagaugcauuggggugagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6797 - RNA, 2449 nt, Artificial Sequence
  KU870645.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauucugcgcaacccuggcuuugcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucuguccacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucgggauuggcgagaaaaagaucacccaccacuggcaucgcuccggaagcacaauuggcaaggccuucgaagcgaccgugagaggggccaaacggauggcugugcucggagauaccgccugggacuuuggcuccgucgggggagcucuuaauucucugggcaaggggauccaccagauuuucggcgccgccuucaaaagccuguuuggaggcauguccugguucucucaaauccucaucgggacacugcugauguggcucggacugaacacgaagaauggcagcauuucccuuaugugucuggcucucgggggagugcugaucuuucugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6798 - RNA, 2449 nt, Artificial Sequence
  KU729217.2 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuuguguccaccaccgucagcaacauggccgaggugcgcucuuacugcuaugaagcuacaaucuccgacauugccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauuguuaaugacaccgggcaugaaacggaugagaaccgggcuaagguggagaucacaccgaauagccccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggcggucgugcucggaucucaggagggcgcuguucauaccgcccuggccggggcucuugaggccgaaauggacggcgcuaagggaagacugagcuccggccaccucaaaugccgccugaagauggauaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgacaugcagacccugacaccugugggaagacucauuaccgccaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggcguuugaagccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6799 - RNA, 2449 nt, Artificial Sequence
  KX087101.3 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaacugcaguacgccggcacagacgggccuugcaaagugcccgcucaaauggccgucgacaugcagacccucacaccugugggaagacugaucaccgcuaaccccgugauuacggaguccacagaaaacagcaagaugaugcuugagcuggaucccccuuucggcgacucuuacaucguuaucggggucggcgagaaaaagauuacccaccacuggcaucgcuccggaagcacaaucggcaaggccuuugaagcgaccgugagaggggccaaacggauggcugugcucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggagugcugauuuuccugagcaccgcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6800 - RNA, 2449 nt, Artificial Sequence
  KY014317.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccaucgaaaacagcaagaugaugcuggagcuugaucccccuuucggcgacucuuacaucgucauuggggugggcgagaaaaagaucacacaccacuggcaucgcuccggaagcaccauuggcaaggccuuugaagcgacagugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacccuccugauguggcugggacucaacacaaagaauggcagcauuucccugaugugucuugcucuugggggaguucucaucuuccugagcacggcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6801 - RNA, 2449 nt, Artificial Sequence
  KU758876.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgucaagggaagacugagcuccggccaccucaaaugccgccugaagauggauaaacuucggcugaagggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucuccuucaugugucuggcccuugggggagugcugauuuuucucagcaccgcugucucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6802 - RNA, 2449 nt, Artificial Sequence
  KU758874.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaaaacugagcuccggccaccucaagugcagacugaagauggauaaacuucgccugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggacggcucaucaccgcuaaccccguuauuacggaguccacagaaaacagcaaaaugaugcuggagcuugaucccccuuucggcgacucuuacaucgucaucggggugggcgagaagaagauuacccaccacuggcauagauccggaagcacaaucggcaaagccuuugaagcgaccgugcgcggggccaagcggauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6803 - RNA, 2449 nt, Artificial Sequence
  KY317939.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaaggaugcuggcgaagccauuucuuuccccacaacccuggggaugaacaaaugcuauauccagauuauggaccucggacacaugugugaugccacaaugagcuacgagugcccuaugcuggacgaaggcguggagccggaugacguggauuguuggugcaauaccacauccaccugggucguguaugggacgugucaucacaagaaaggagaagcuagacggucucgcagagccguuacccuucccagccauuccacacggaagcugcaaacccgcucucagacauggcucgagagcagagaguacaccaaacaccugauccggguggaaaacuggauuuuucgcaauccuggcuucgcucuggccgcggccgcuaucgccuggcuccugggcuccagcacgucucagaaggucaucuaucuugugaugauucugcucaucgcucccgccuacuccauuagaugcaucgggguuagcaaccgggacuuuguggagggaaugucuggcgggacaugggucgauguggugcuggaacauggaggcugugucaccguuauggcgcaggacaagccuacaguggauauugagcuugugaccaccacagucuccaauauggccgaggugcgcagcuacugcuaugaagcuagcaucuccgacauggccagcgauuccagaugucccacgcaaggggaggcuuaccuggacaaacagucugacacccaguauguuugcaagcggacacucguggaucgcggauggggcaacggcugugggcuguucggaaaaggcagccuggugaccugcgccaaguuugccugcuccaaaaagaugacagggaagucuauucagccugaaaaucucgaguacagaaucaugcugucugugcacggaucccaacacagcggcaugaucguuaacgacaccgggcaugaaacggaugagaaucgggcuaaaguggagauuacaccgaacucucccagagcggaagccacccuuggaggcuucggcagccuggggcucgacugugagccucgcaccggacuggauuuuuccgaccuuuauuaccugacaaugaauaacaagcacuggcucguccauaaagaaugguuccacgauaucccccugccuuggcacgcuggcgccgacaccgggacaccccauuggaauaacaaggaggcccugguggaauuuaaagaugcucacgccaagcggcagacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggaagacucaucaccgcuaaucccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaacucucugggcaaagggauucaccagaucuucggcgccgccuuuaagagccuguucggaggcauguccugguuuucucaaauucuuaucgggacacuccugauguggcugggacucaauacgaaaaacggcagcaucucccugaugugucuugcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6804 - RNA, 2449 nt, Artificial Sequence
  KY014314.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaggcucacgccaaacggcagacggucgugguucucggaucucaggagggcgcggugcauaccgcucuggccggggcccuugaagcugagauggauggcgccaagggaagacugagcuccggccaccucaaaugccgccugaagauggacaaacuucggcugaaaggggucagcuauucucucuguacagcugccuucaccuuuacaaagauuccggcggaaacccugcauggaacggugaccguugaggugcaguacgccggcacagaugggccuugcaaaguccccgcucaaauggccguggacaugcagacccugacaccugugggaagacucaucaccgcuaaccccguuauuacggaauccacagagaacagcaagaugaugcuggagcuugacccgccuuucggcgauucuuacaucgucaucggggugggcgaaaagaagauuacccaccacuggcaucgcuccggaagcacaaucggcaaggccuuugaggcgaccgugagaggggccaaacggauggcuguccugggagacaccgccugggauuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6805 - RNA, 2449 nt, Artificial Sequence
  KX447517.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccgcucuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaacccuuauugggacacuccugauguggcugggacucaacacgaagaauggcagcaucucccugaugugucuugcgcuugggggaguucucaucuuccugagcaccgccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6806 - RNA, 2449 nt, Artificial Sequence
  KU926310.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcgcugacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggaguucucauuuuccugagcacggccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6807 - RNA, 2449 nt, Artificial Sequence
  KU922923.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugccccaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucuggccuacuccauuagaugcaucgggguuagcaaucgggacuuuguggagggaaugucuggcgggacaugggucgauguggugcuugaacauggaggcugugucaccguuauggcgcaggacaagcccacaguggauauugagcuggugaccaccacagucuccaacauggccgaggugcgcagcuacugcuaugaagcuagcaucuccgacauggccagcgauuccagauguccuacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauucagcccgaaaaccuggaguacagaaucaugcuuucugugcacggaucccaacacagcggcaugaucguuaaugacaccgggcaugaaacggaugagaaccgggcuaagguggagauuacaccuaauucuccgagagcggaagccacccugggaggcuucggcagccucgggcuggacugugagccccgcaccggacuugauuuuuccgaccuguauuaccucacaaugaacaauaaacacuggcugguccauaaggaaugguuccacgauaucccucugcccuggcacgcuggcgccgacaccgggacaccucauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagauucccgcggagacccugcauggaacggugaccguugaagugcaguacgccggcacagacgggccgugcaaagucccugcucaaauggccguggacaugcagacccucacacccgugggaagacugaucaccgcuaacccuguuauuacggaguccacagaaaacagcaagaugaugcuugagcuggauccucccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuguucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6808 - RNA, 2449 nt, Artificial Sequence
  KY075937.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacaugguuagcgauuccagaugucccacgcaaggggaggccuaccuggacaagcagucugacacccaguaugugugcaaacggacacucgucgaucgcggauggggcaauggcugugggcuguucggaaagggcagccuggugaccugcgcuaaauuugccugcuccaagaaaaugacagggaagucuauucagccugaaaaccucgaguacagaaucaugcugucuguucacggaucccaacacagcggcaugaucgugaaugacaccgggcaugaaacggaugagaaccgggccaaggucgagauuacacccaauucuccgagagcugaagcgacccuuggaggcuucggcagccuggggcucgacugugagccucgcaccggacuggauuuuuccgaccuuuauuaccugacaaugaacaauaaacacuggcucgugcauaaggaaugguuccacgauaucccccugccuuggcacgccggcgcugacaccgggacaccccauuggaacaauaaagaggcccuggucgaauuuaaggaugcccacgcuaaacggcagacggugguugugcucggaucucaggagggcgccguccauaccgcgcuggcuggggcccuugaggccgaaauggacggcgcuaagggaagacugagcuccggccaccucaaaugccgccugaagauggauaagcugcggcugaaaggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucucccugaugugucuugcccuugggggagugcucauuuuccugagcaccgcugucucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6809 - RNA, 2449 nt, Artificial Sequence
  KY003156.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggauuagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcauucuggggcucgacugugagccucgcaccggacuggauuuuagcgaccuuuauuaccugacaaugaacaauaaacacuggcucgugcauaaggaaugguuccacgauaucccccugccuuggcacgcuggcgccgacaccgggacaccccauuggaacaauaaagaggcccuggucgaauuuaaggaugcucacgccaaacggcagacgguggucgugcucggaucccaggagggcgcgguucauaccgcucuggccggggcccuugaggcugaaauggacggcgccaagggaagacugucuagcggccaccucaaaugccgccugaagauggauaagcugcggcugaaagggguguccuauagccucuguacagcugccuucaccuuuacaaagauuccggcggagacccugcauggaacggucaccguggaaguucaguacgccggcacagacgggccuugcaaagugcccgcucaaauggccgucgacaugcagacccugacaccugugggaagacucaucaccgcuaaccccgugaucacggagucuacagaaaacuccaagaugaugcuggagcuugaucccccuuucggcgacagcuacauuguuaucggggucggcgagaaaaagauuacccaccacuggcaucgcucuggauccacaaucggcaaggccuuugaagcgaccgugagaggggccaaacggauggcugugcugggagauaccgccugggacuucggcagcgucgggggagcucucaauucccugggcaaggggauucaccagaucuucggcgccgccuuuaaaucucuguucggaggcaugagcugguuuucccaaauccuuauugggacacuccugauguggcugggacucaacacgaagaauggcucuaucagccugaugugucuugcucuugggggagugcucauuuuccuguccaccgcgguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6810 - RNA, 2449 nt, Artificial Sequence
  KU312313.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccauccggaaacugcaaacccgcucucagacauggcucgagagcagagaguacaccaagcaccugauucggguggaaaauuggaucuuucgcaacccuggcuucgcucuggccgcggccgcuaucgccuggcuccugggcuccagcacgucucagaaagucauuuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucugugcacggaucccaacacagcggcaugauuguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacaucgucauuggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacgcuaagaauggcagcauuucccugaugugucuugcgcuugggggaguucucaucuuccugagcacggccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6811 - RNA, 2449 nt, Artificial Sequence
  KY075935.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcucaaagaucucggcgcgccguuacccuucccagccauuccacaagaaaacugcagacccggucucagacauggcucgagagccgcgaguacaccaagcaccugaucagaguggaaaauuggauuuuucggaacccuggcuucgcucuggccgcggccgcuaucgccuggcuccugggcuccagcacgucucagaaagucaucuaucuugugaugauucugcucaucgcucccgccuacuccauucgcugcaucgggguuagcaauagagacuuuguggagggaaugucuggcgggacaugggucgauguggugcuggaacauggaggcugugucaccguuauggcgcaagacaagccuacaguggauauugagcuugugaccaccacagucuccaacauggccgaggugcggagcuacugcuaugaagcuagcaucuccgacauggccagcgauucccgcugucccacgcagggggaggcuuaccuggacaagcagucugacacccaguauguuugcaaaagaacacucguggaucggggauggggcaauggcugugggcuguucggaaagggcagccuggugaccugcgccaaauuugccugcuccaagaaaaugacagggaagucuauucaaccugaaaaccucgaguaccgcaucaugcugucugugcacggaucccagcacagcggcaugaucguuaaugacaccgggcaugaaacggaugagaacagagcuaagguggagauuacacccaauucuccgcgggcggaagccacccuuggaggcuucggcagccuggggcucgacugugagccuagaaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacgccagacggucgugguucucggaucucaggagggcgcggugcauaccgcucuggccggggcccuugaggcugaaauggacggcgccaagggacggcugagcuccggccaccucaaaugcagacugaagauggauaagcugcgccugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggacggcucaucaccgcuaaccccguuauuacggaguccacagaaaacagcaagaugaugcuggagcuugaucccccuuucggcgacucuuacaucgucaucggggugggcgagaaaaagauuacccaccacuggcauagauccggaagcacaaucggcaaggccuuugaagcgaccgugcgcggggccaaacggauggcuguccugggagauaccgccugggacuucggcuccgucgggggagcucucaauucucugggcaaggggauucaccaaaucuucggcgccgccuuuaaaagccuguucggaggcauguccugguuuucucagauucuuaucgggacacuccugauguggcugggacucaacacgaagaauggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6812 - RNA, 2449 nt, Artificial Sequence
  KY014320.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaagcucgcucucagaccuggcucgagagcagagaguacacaaagcaccugauccggguggaaaauuggauuuuucgcaacccuggcuucgcccuggcggccgcugccaucgcuuggcuccugggcuccagcaccucucagaaagucaucuaucuugugaugauucugcucaucgcccccgcguacuccauuagaugcaucgggguuagcaaucgggacuuuguggagggaaugucuggcgggacgugggucgauguggugcuggaacauggaggcugugucacaguuauggcccaggacaagccuaccguggauauugagcuugugacaaccaccgucuccaacauggcugaggugcgcagcuacugcuaugaagccucuaucuccgacauggcuagcgauuccagaugucccacacaaggggaggccuaccuggacaagcagucugacacgcaguauguuugcaaacggacccucguggaucgcggauggggcaauggcugugggcuguucggaaagggcagccuggucacaugcgccaaauuugcuugcuccaagaaaaugaccggaaagagcauucagccugaaaaccucgaguacagaaucaugcugucugugcacgggucccaacacagcggcaugaucguuaaugacacagggcaugaaaccgaugagaaccgggcgaagguggagauuacgcccaauucucccagagccgaagcuacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccguugggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggagugcucauuuuccugagcacggccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6813 - RNA, 2449 nt, Artificial Sequence
  KY328290.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaaacuucggcugaaaggggucucuuauucccucuguacagcugccuucaccuuuagcaagauuccggcggagacacugcauggaaccgugacggaagagguucaguacgccggcaccgacgggccuugcaaagugcccgcucaaauggccgucgacaugcagacacugaccccugugggaagacucaucacagcuaaucccgugauuaccgaaucuacggagaacuccaagaugaugcuggagcuugaucccccuuucggcgacagcuacaucguuaucggggucggcgaaaagaagauuacacaccacuggcaucgcuccggaucuaccaucggcaaggccuuugaggcgacagugagaggggccaaacggauggcugugcugggagauaccgccugggacuucggcagcgucgggggagcucucaacucccugggcaaggggauucaccagaucuucggcgccgccuuuaaaucucuguucggaggcaugagcugguuuucccaaauucuuaucgggacccuccugauguggcugggacucaauacaaagaacggcagcaucucucugaugugucuugcucucgggggagugcugauuuuccuguccacggcgguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6814 - RNA, 2449 nt, Artificial Sequence
  KU681081.3 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacaccggcgcugacacagggacgccccauuggaauaacaaagaggcccugguggaauuuaaggaugcccacgcuaaacggcagaccgucgugguucucggaagccaggagggcgccgugcauacagcgcuggcuggggcccuugaggccgaaauggacggcgcuaagggaagacuguccagcggccaccucaaaugccgccugaagauggauaaacuucggcugaagggggucucuuauucccucuguaccgccgcuuucacauuuaccaagauuccggccgagacgcugcauggaaccgugacaguugaagugcaguacgcgggcaccgacgggccuugcaaaguccccgcccaaauggcuguggacaugcagacacugaccccugugggaagacucaucacggccaaucccguuauuacagagggcaccgaaaacagcaagaugaugcuggagcuugaucccccuuucggggacucuuacaucgucaucggcgugggagagaaaaagauuacacaccacuggcaucgcuccggcagcaccaucgggaaggcuuuugaagccaccgugcggggagcgaaaagaauggccguccugggcgauacagcuugggacuucggguccgugggaggcguucucaacucucuggggaagggcauucaccagaucuucggagccgcuuuuaaaagccuguucggcgggauguccugguuuucucaaauucuuaucggaacgcuccugauguggcugggccucaauaccaagaacgggagcaucucccugaugugucuugcccugggaggcgugcucauuuuccugagcacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6815 - RNA, 2449 nt, Artificial Sequence
  KX827309.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugaugugucuugcucuugggggaguucucauuuuccugucuaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6816 - RNA, 2449 nt, Artificial Sequence
  KU955593.1 prME-short mRNA Design 2 opt
ggggcgcugccuacggagguggcagccaucuccuucucggcaucaagcuuaccaugaccagcgugggcaucgucgggcugcuccugacaacggccauggcuguugaggugaccagacggggaaacgccuacuauauguaccuugaccgcuccgaugcgggcgaagcuauuucuuuccccacaaccauggggaugaauaagugcuauauccagauuauggaccugggacacaugugugaugccacaaugagcuacgagugcccuaugcucgacgaaggcguggagccggaugacgucgauuguuggugcaacaccacauccaccugggugguuuaugggacgugucaucacaaaaagggagaagccagacggucucgcagagcugugacccugcccagccauuccacacggaaacuucaaacccgcucucagacauggcuggagagcagagaguacaccaagcaccucauccgggucgaaaauuggauuuuucgcaacccuggcuucgcccuggcugccgcggccaucgcuuggcugcucggcuccagcacgucucagaaagugaucuaucugguuaugauucuucugaucgcccccgcuuacuccauuagaugcaucggggugagcaaucgggacuuugucgagggaaugucuggcgggacauggguggaugugguccucgaacauggaggcuguguuaccgugauggcccaggacaagccuacaguggauauugagcuggucaccaccacaguguccaacauggcggagguucgcagcuacugcuaugaagccucuaucuccgacauggcuagcgauuccagaugucccacgcaaggggaggccuaccuugacaagcagucugacacccaguaugugugcaaacggacacuggucgaucgcggauggggcaauggcugugggcuguucggaaagggcagccuggugaccugcgcuaaauuugccugcuccaagaaaaugacagggaagucuauucagccugaaaaccuggaguacagaaucaugcucucuguucacggaucccaacacagcggcaugaucgugaaugacaccgggcaugaaacggaugagaaccgggccaaggucgagauuacaccgaauagccccagagcugaagcgacccugggaggcuucggcagccuugggcuggacugugagccucgcaccggacucgauuuuuccgaccuguauuaccuuacaaugaacaauaaacacuggcuggugcauaaggaaugguuccacgauaucccccucccuuggcacgccggcgcugacaccgggacaccccauuggaacaauaaagaggcccuggucgaauuuaaggaugcccacgcuaaacggcagacggugguugugcugggaucucaggagggcgccguccauaccgcgcucgcuggggcccuggaggccgaaauggacggcgcuaagggaagacuuagcuccggccaccugaaaugccgccucaagauggauaagcugcggcuuaaaggggugagcuauucucuguguacagccgcuuucaccuuuacaaagauuccggccgagacccuccauggaacgguuaccguggaaguccaguacgcgggcacagacgggccuugcaaagugcccgcccaaauggcuguggacaugcagacccugacaccuguuggaagacugaucaccgccaaccccgucauuacggaguccacagaaaacagcaagaugaugcucgagcuggaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcuuggagauaccgcuugggacuucggcuccguugggggagcccucaauucucucggcaaggggauucaccagaucuucggcgcugccuuuaaaagccuguucggaggcauguccugguuuucucaaauucugaucgggacacuucucguguggcugggacugaacacgaagaauggcagcaucucccucaugugucuggcccuugggggaguccugauuuuccucagcaccgcugugucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6817 - RNA, 2449 nt, Artificial Sequence
  KY272987.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugguuugucuugcucuugggggagugcucauuuuccugucuaccgcggucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6818 - RNA, 2449 nt, Artificial Sequence
  KY007221.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuaacaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugguuugucuugcucuugggggagugcucauuuuccugagcaccgcggucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6819 - RNA, 2449 nt, Artificial Sequence
  EU545988.1 prME-short mRNA Design 2 opt
ggggcgcugccuacggagguggcagccaucuccuucucggcaucaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggccaucgcuuggcuccugggcagcucuacgucccagaaagugaucuaucuuguuaugauucugcucaucgcccccgcuuacagcauuagaugcaucggggugucuaaccgggacuuugucgagggaauguccggcgggacauggguggaugugguccuggaacauggaggcuguguuaccgugauggcccaggacaagccugcgguggauauugagcuugucacaaccaccgugagcaauauggccgagguucgcucuuacugcuaugaagccuccaucagcgacauggcuuccgauucuagaugucccacacaaggggaggcuuaccuggacaagcagagcgacacgcaguaugugugcaaacggacccucgucgaucgcggauggggcaacggcugugggcuguucggaaagggcucccuggugacaugcgccaaauuugccugcagcaagaaaaugaccgggaagucuauucagccugaaaaucucgaguacagaaucaugcuguccguucacggaagccaacacucuggcaugaucgugaacgacacagggcaugaaaccgaugagaaucgggcuaaggucgagauuacgccgaacagccccagagcggaagccacacuuggaggcuucggcucccuggggcucgacugugagccucgcaccggacuggauuuuucugaccuuuauuaccugaccaugaauaacaaacacuggcucgugcauaaggaaugguuccacgauaucccccugccuuggcacgcuggcgccgacacagggacaccccauuggaauaacaaagaggcccuggucgaauuuaaggaugcucacgccaaacggcagaccgugguugugcucggaagccaggagggcgcgguccauacggcucuggccggggcccuugaggcugaaauggacggcgccaagggaagacuguccagcggccaccucaaaugccgccugaagauggauaagcugcggcugaaaggggugucuuauucccucuguaccgcugccuucacauuuaccaagauuccggcggagacacugcauggaaccguuacgguggaaguccaguacgccggcaccgacgggccuugcaaagugcccgcucaaauggccguggacaugcagacacugaccccuguuggaagacucaucacagcuaaucccgucauuaccgagagcacggaaaacucuaagaugaugcuggagcuugaucccccuuucggcgacuccuacaucgugaucggggugggcgagaaaaagauuacacaccacuggcaucgcagcggauccaccaucggcaaggccuuugaagcgacagucagaggggccaaacggauggcugugcugggagauaccgccugggacuucggcucuguugggggagcucucaacagccugggcaaggggauucaccagaucuucggcgccgccuuuaaaucccuguucggaggcaugucuugguuuagccaaauucuuaucgggacccuccugguguggcugggacucaauacaaagaacggcuccaucagccugacgugucuugcucuugggggaguccucauuuuccugucuaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6820 - RNA, 2449 nt, Artificial Sequence
  KU681082.3 prME-short mRNA Design 2 opt
ggggcgcugccuacggagguggcagccaucuccuucucggcaucaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggugaucgccuggcuccugggcagcucuacgucccagaaaguuaucuaucuugugaugauucugcucaucgcucccgccuacagcauuagaugcaucggggucucuaaccgggacuuuguggagggaauguccggcgggacauggguggaugucguucuggaacauggaggcugugugaccgugauggcucaggacaagccuacagucgauauugagcuugugaccaccacaguuagcaauauggccgaggugcgcucuuacugcuaugaagcguccaucagcgacauggccuccgauucuagaugucccacgcaaggggaggcuuaccuggacaagcagagcgacacccaguaugucugcaaacggacacucguggaucgcggauggggcaacggcugugggcuguucggaaagggcucccugguuaccugcgccaaauuugcuugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagccgaagcuacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcgggcgccgacaccgggacaccccauuggaauaacaaagaggcucugguggaauuuaaggaugcccacgccaaacggcagacgguugugguccucggaagccaggagggcgcugugcauaccgcccuggcgggggcucuugaggccgaaauggacggcgccaagggaagacuguccagcggccaccucaaaugccgccugaagauggauaagcugcggcugaaagggguuucuuauucccucuguacagcugccuucaccuuuacaaagauuccggcugagacccugcauggaacggugaccgucgaagugcaguacgccggcacagacgggccuugcaaagugcccgcgcaaauggccguugacaugcagacccugacaccugucggaagacucaucaccgcuaaucccgugauuacggagagcacagaaaacucuaagaugaugcuggagcuugaucccccuuucggcgacuccuacaucgugaucggggucggcgagaaaaagauuacccaccacuggcaucgcagcggauccacaaucggcaaggccuuugaagcuaccgugagaggggccaaacggauggcgguucugggagauaccgccugggacuucggcucugucgggggagcucucaacagccugggcaaggggauucaccagaucuucggcgccgcuuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagccguuuccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6821 - RNA, 2449 nt, Artificial Sequence
  KX601167.1 prME-short mRNA Design 2 opt
ggggcgcugccuacggagguggcagccaucuccuucucggcaucaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccugggggugaacaagugcuauauccagauuauggaccucggacacaugugugaugccacaauguccuacgagugcccuaugcuggacgaaggcgucgagccggaugacguggauuguuggugcaauaccacaucuaccuggguuguguaugggacgugucaucacaaaaagggagaagccagacggagccgcagagcugucacccuucccucccauucuacacggaaacugcaaacccgcagccagacauggcucgaguccagagaguacaccaagcaccugauccggguggaaaacuggauuuuucgcaauccuggcuucgcccuggcugccgcggccaucgcuuggcuccugggcagcucuacgucccagaaaguuaucuaucuugugaugauucugcucaucgcccccgcuuacagcauuagaugcaucggggucucuaaccgggacuuuguggagggaauguccggcgggacauggguggaugucguucuggaacauggaggcugugugaccgugauggcccaggacaagccuacagucgauauugagcuugugaccaccacaguuagcaauauggcggaggugcgcucuuacugcuaugaagccuccaucagcgacauggcuuccgauucuagaugucccacgcaaggggaggccuaccuggacaagcagagcgacacccaguaugucugcaaacggacacucguggaucgcggauggggcaacggcugugggcuguucggaaagggcucccugguuaccugcgcuaaauuugccugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagcugaagcgacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgccggcgcugacaccgggacaccccauuggaauaacaaagaggcccugguggaauuuaaggaugcccacgcuaaacggcagacgguugugguccucggaagccaggagggcgccgugcauaccgcgcuggcuggggcccuugaggccgaaauggacggcgcuaagggaagacuguccagcggccaccucaaaugccgccugaagauggauaagcugcggcugaaagggguuucuuauucccucuguacagccgcuuucaccuuuacaaagauuccggccgagacccugcauggaacggugaccgucgaagugcaguacgcgggcacagacgggccuugcaaagugcccgcccaaauggcuguugacaugcagacccugacaccugucggaagacucaucaccgccaaucccgugauuacggagagcacagaaaacucuaagaugaugcuggagcuugaucccccuuucggcgacuccuacaucgugaucggggucggcgauaaaaagauuacccaccacugguaucgcagcggauccacaaucggcaaggcuuuugaggccaccgugagaggggcgaaacggauggccguucugggagacaccgcuugggauuucggcucugucgggggagcccucaacagccugggcaaggggauucaucagaucuucggcgcugccuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagcuguuuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6822 - RNA, 2449 nt, Artificial Sequence
  KX694533.2 prME-short mRNA Design 2 opt
ggggcgcugccuacggagguggcagccaucuccuucucggcaucaagcuuaccaugaccagcgugggcaucgucgggcugcuccugacaacggccauggcuguugaggugaccagacggggauccgccuacuauauguaccuugaccgcucugaugcgggcaaggcuauuagcuuccccacaacccugggggugaacaaaugcuauauccagauuauggaccucggacacaugugugaugccacaauguccuacgaaugcccuaugcuggacgagggcgucgaaccggaugacguggauuguuggugcaauaccacaucuaccuggguuguguaugggacgugucaucacaagaaaggagaggccagacggagccgcagagcugucacccuucccucccauucuacacggaagcugcaaacccgcagccagacauggcucgaauccagagaguacaccaaacaccugauccggguggagaacuggauuuuucgcaauccuggcuucgcccuggcugccgcggccaucgcuuggcuccugggcagcucuacgucccagaagguuaucuaucuugugaugauucugcucaucgcccccgcuuacagcauuagaugcaucggggucucuaaccgggacuuuguggaaggaauguccggcgggacauggguggaugucguucuggagcauggaggcugugugaccgugauggcccaggacaagccuacagucgauauugaacuugugaccaccacaguuagcaauauggcggaggugcgcucuuacugcuaugaggccuccaucagcgacauggcuuccgauucuagaugucccacgcaaggggaagccuaccuggacaaacagagcgacacccaguaugucugcaagcggacacucguggaucgcggauggggcaacggcugugggcuguucggaaaaggcucccugguuaccugcgcuaaguuugccugcagcaaaaagaugacagggaagucuauucagccugagaaucucgaauacagaaucaugcuguccgugcacggaagccaacacucuggcaugaucgucaacgacauugggcaugagaccgaugaaaaucgggccaaaguggagaucacgccgaacagccccagagcugaggcgacacuuggaggcuucggcucccuggggcucgacugugaaccucgcaccggacuggauuuuucugaccuuuauuaccugaccaugaauaacaagcacuggcucguccauaaagagugguuccacgauauuccccugccuuggcacgccggcgcugacacagggacaccccauuggaauaacaaggaagcccugguggaguuuaaagaugcccacgcuaagcggcagacaguugugguccucggaagccaggaaggcgccgugcauacggcgcuggcuggggcccuugaggccgagauggacggcgcuaaaggaagacuguccagcggccaccucaagugccgccugaagauggauaaacuucggcugaaggggguuucuuauucccucuguaccgccgcuuucacauuuaccaaaaucccggccgaaacacugcauggaaccgugacggucgaggugcaguacgcgggcaccgacgggccuugcaaggugcccgcccaaauggcuguugacaugcagacacugaccccugucggaagacucauuacagccaaucccgugaucaccgaaagcacggagaacucuaaaaugaugcuggaacuugaucccccuuucggcgacuccuacaucgugauuggggucggcgauaagaagaucacacaccacuggcaucgcagcggauccaccauuggcaaggcuuuugaggccacagugagaggggcgaaacggauggccguucugggagacaccgcuugggauuucggcucugucgggggagcccucaacagccugggcaaagggauccaccagauuuucggcgcugccuuuaagucccuguucggaggcaugucuugguuuagccaaauccuuaucgggacccuccugguguggcugggacucaauaccaaaaacggcuccauuagccugacgugucuugcccucgggggagugcugaucuuccugucuaccgcuguuuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6823 - RNA, 2449 nt, Artificial Sequence
  KY288905.1 prME-short mRNA Design 2 opt
ggggcgcugccuacggagguggcagccaucuccuucucggcaucaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacacagggcacgagaccgaugaaaauagagcuaagguggaggucaccccuaacagcccgcgggccgaggccacacuuggaggcuucggcucccuggggcucgacugugaacccagaaccggacuggauuuuucugaccuuuacuaucugacaaugaauaacaaacauuggcucgugcacaaggagugguuccacgauaucccucugcccuggcaugcuggcgcggacacggggaccccucacuggaauaacaaagaagcccugguugaguuuaaggaugcucaugccaaacgccagacaguggucgugcucggaagccaggaaggcgccguucacaccgcucuggccggggcgcuugaggcugagauggacggcgccaagggacggcuguucuccggccaucucaagugcagacugaaaauggauaaacuucgccugaagggggugagcuacucucucuguacagccgcuuuuaccuucacgaagguccccgccgaaacccugcacggaacagugaccguggagguucaguaugcuggcacagacgggccgugcaaagucccugcccaaauggcgguggacaugcagacccugacgcccgugggacggcucauuacagccaauccugucaucaccgaauccacagagaacagcaagaugaugcuggaacuugauccucccuuuggcgacucuuacauugugaucgggguuggcgauaagaaaaucacccaccauuggcacagauccggaagcaccauuggcaaggcuuucgaggccacagugcgcggggcuaaacggauggccguccugggagacacggcgugggauuucggcuccguugggggaguguuuaacucucucggcaaggggauccaucagauuuucggcgccgcuuuuaaaagccuguucggaggcauguccugguuuucucaaauccugauugggacccuucucguguggcugggacugaauacaaagaacggcagcaucucccucaccugucuggcccuugggggagucaugaucuuccugagcacagcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6824 - RNA, 2449 nt, Artificial Sequence
  KF268950.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacauugggcacgagaccgaugaaaacagagccaagguggaggucacgccuaauagcccgcgggcugaggcgacacuuggaggcuucggcucccuggggcucgacugugaacccagaaccggacuggauuuuucugaccuuuacuaucugaccaugaacaauaaacauuggcucgugcacaaggagugguuccacgauaucccucugcccuggcaugccggcgcugacacagggaccccucacuggaacaauaaagaagcccuggucgaguuuaaggaugcccaugcuaaacgccagacagugguugugcucggaagccaggaaggcgccguccacacggcgcuggcuggggcccuugaggccgagauggacggcgcuaagggacggcuguucuccggccaucucaagugcagacugaaaauggauaaacuucgccugaagggggugagcuacucucucuguaccgccgcuuuuacauucaccaagguucccgccgaaacacugcacggaaccgugacggucgaggugcaguaugcgggcaccgacgggccgugcaaagugccugcccaaauggcuguugacaugcagacacugacccccgucggacggcucauuacagccaacccugugaucaccgaauccacggagaacagcaagaugaugcuggaacuugauccucccuuuggcgacucuuacaucgugauuggggucggcgauaagaaaaucacacaccauuggcacagauccggaagcaccauuggcaaggcuuucgaggccacagugcgcggggcgaaacggauggccguucugggagacaccgcuugggauuucggcuccgucgggggaguguuuaauucucucggcaagggggugcaucagaucuucggcgccgcuuuuaaaagccuguucggaggcauguccugguuuucucaaauucugaucgggacccuucucguuuggcugggacugaacacaaagaauggcagcaucucccucacgugucuggcccuugggggagugaugauuuuccugagcaccgccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6825 - RNA, 2449 nt, Artificial Sequence
  KF383121.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacauugggcacgagacggaugaaaauagagccaaggucgaggugacaccuaacagcccgcgggccgaggcuacccuuggaggcuucggcucccuggggcucgacugugaacccagaaccggacuggauuuuucugaccuuuacuaucugacaaugaauaacaaacauuggcucguccacaaggagugguuccacgauaucccucugcccuggcaugcgggcgccgacaccgggacaccucacuggaauaacaaagaagcucugguggaguuuaaggaugcccaugccaaacgccagacgguugugguccucggaagccaggaaggcgcugugcacaccgcccuggcgggggcucuugaggccgagauggacggcgccaagggacggcuguucuccggccaucucaagugcagacugaaaauggauaaacuucgccugaaggggguuagcuacucucucuguacagcugccuuuaccuucacaaaggugcccgcugaaacccugcacggaacggucaccguggaggugcaguaugccggcacagacgggccgugcaaaguuccugcgcaaauggccgucgacaugcagacccugacacccgugggacggcucauuaccgcuaauccugugaucacggaauccacagagaacagcaagaugaugcuggaacuugauccucccuuuggcgacucuuacaucgucauuggggugggcgauaagaaaaucacccaccauuggcacagauccggaagcacaauuggcaaggccuucgaggcuaccguucgcggggccaaacggauggcggugcugggagacaccgccugggauuucggcuccgucgggggaguguuuaacucucucggcaaggggauccaucagauuuucggcgcugccuuuaaaagccuguucggaggcauguccugguuuucucaaauccugaucgggacacuucucguuuggcugggacugaauacgaagaacggcagcauuucccucaccugucuggcucuugggggagugaugaucuuccugagcacagccgucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6826 - RNA, 2431 nt, Artificial Sequence
  KF268949.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacgagaacagagccaagguggaagucaccccuaauagcccgcgggcugaggcgacgcuugggggauucggcucccugggccucgauugugagcccagaacagggcuggacuuuucugaucuuuacuaucugaccaugaacaauaaacacuggcucgugcauaaggaaugguuccacgacauuccucugcccuggcacgccggagcugauaccggcacaccucauuggaacaauaaagaggcccuggucgaauuuaaggacgcccacgcuaaacgccagaccgugguugugcucgggagccaggagggagccguccauacagcgcuggcuggcgcccuugaagccgagauggauggggcuaagggccggcuguucuccggacaccucaagugcagacugaaaauggacaaacuucgccugaagggcgugagcuacucucucuguacggccgcuuuuaccuucacaaagguucccgccgagacccugcaugggacagugaccgucgaagugcaguaugcgggaacggauggcccgugcaaagugccugcccaaauggcuguugacaugcagacccugacacccgucgggcggcucaucaccgccaacccugugauuacagaguccaccgaaaacagcaagaugaugcuggagcuugacccucccuuuggagauucuuacaucgugaucggcgucggggacaagaaaauuacgcaccacuggcauagauccggcagcacaaucggaaaggcuuucgaagccaccgugcgcggcgcgaaacggauggccguucugggggauacagcuugggacuucggauccgugggcggggucuuuaauucucucggaaagggcauucaccagaucuucggggccgcuuuuaaaagccuguucggcggaauguccugguuuucucaaauucugaucggcacccuucucguguggcuggggcugaacaccaagaauggaagcaucucccucacaugucuggcccuuggcgggguuaugauuuuccugagcacggccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6827 - RNA, 2449 nt, Artificial Sequence
  KU955595.1 prME-short mRNA Design 2 opt
ggggcgcugccuacggagguggcagccaucuccuucucggcaucaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacacggggcacgagacagaugaaaauagagccaagguggaggucaccccuaacagcccgcgggccgaggcuacccuuggaggcuucggcucccuggggcucgacugugaacccagaacaggacuggauuuuucugaccuuuacuaucugaccaugaauaacaaacauuggcucgugcacaaggagugguuccacgauaucccucugcccuggcaugcgggcgccgacacagggacgccucacuggaauaacaaagaagcucugguugaguuuaaggaugcccaugccaaacgccagaccguggucgugcucggaagccaggaaggcgcuguucacacagcccuggcgggggcucuugaggccgagauggacggcgccaagggacggcuguucuccggccaucucaagugcagacugaaaauggauaaacuucgccugaagggggugagcuacucucucuguaccgcugccuuuacauucaccaagguccccgcugaaacgcugcacggaaccgugacaguggagguucaguaugccggcaccgacgggccgugcaaagucccugcgcaaauggccguggacaugcagacacugacccccgugggacggcucauuacggcuaauccugucaucacagaauccaccgagaacagcaagaugaugcuggaacuugauccucccuuuggcgacucuuacauugugaucgggguuggcgauaagaaaaucacacaccauuggcacagauccggaagcaccauuggcaaggccuucgaggcuaccgugcgcggggccaaacggauggcgguccugggagacacagccugggauuucggcuccguugggggaguguuuaacucucucggcaaggggauccaucagauuuucggcgcugccuuuaaaagccuguucggaggcauguccugguuuucucaaauccugauugggacgcuucucguguggcugggacugaauaccaagaacggcagcaucucccucacaugucuggcucuugggggagucaugaucuuccugagcaccgccgugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6828 - RNA, 2449 nt, Artificial Sequence
  KF383116.1 prME-short mRNA Design 2 opt
ggggcgcugccuacggagguggcagccaucuccuucucggcaucaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaacacaagaaaggagaggccagacggagccgcagagcuguuacccuuccgucccauucuacacggaagcugcagacccgcagccagacauggcucgaauccagagaguauaccaaacaccugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcauggaggcugugugaccgugauggcccaagacaaacccacagucgauaucgaacuugugaccaccacaguuagcaauauggcggaggugcggucuuacugcuacgaggccuccauuagcgacauggcuuccgauucucgcuguccuacgcagggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccaacccgagaaucucgaauaucgcaucaugcuguccgugcacggaagccagcacucuggcaugauugucaacgacaucgggcaugagacggaugaaaauagagccaagguggaggucacaccuaacagcccgcgggccgaggcuacccuuggaggcuucggcucccuggggcucgacugugaacccagaaccggacuggauuuuucugaccuuuacuaucugacaaugaauaacaaacacuggcucgugcauaaggagugguuccacgauauuccucugcccuggcacgcgggcgccgacaccgggacaccucauuggaauaacaaagaagcucugguugaguuuaaggaugcccacgccaaacgccagacgguggucgugcucggaagccaggaaggcgcuguucauaccgcccuggcgggggcucuugaggccgagauggacggcgccaagggacggcuguucuccggccaccucaagugcagacugaaaauggauaaacuucgccugaagggggugagcuacucucucuguacagcugucugcaccgccgcuaaggugcccgccgaaacacugcauggaaccgugacgguugagguccaauaugcgggcaccgacgggccguguaaagugccugcccagauggcuguggacaugcagacacugacccccgucggacggcucaucacagccaauccugugauuaccgaauccacggagaacagcaagaugaugcuggaacuugauccucccuuuggcgacucuuacaucguuaucggggugggcgauaagaaaauuacacaccacuggcauagauccggaagcaccaucggcaaggcuuucgaggccacaguccgcggggcgaaacggauggccgugcugggagacaccgcuugggauuuuggcuccguugggggaguguucaacucucucggcaaggggauucaccaaaucuucggcgccgcuuuuaaaagccuguucggaggcauguccugguuuucucagauucugaucgggacccuucucgucuggcugggacugaauacaaagaacggcagcaucucccucacgugccuggcccuugggggagugaugauuuuccugagcaccgccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6829 - RNA, 2431 nt, Artificial Sequence
  KX601166.1 prME-short mRNA Design 2 opt
ggggcgcugccuacggagguggcagccaucuccuucucggcaucaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacgagaauagagccaagguggaagucacgccuaacagcccgcgggccgaggcuacacuugggggauucggcucccugggccucgauugugagcccagaaccgggcuggacuuuucugaucuuuacuaucugaccaugaauaacaaacacuggcucgugcauaaggaaugguuccacgacaucccucugcccuggcacgcgggagccgauacaggcaccccucauuggaauaacaaagaggcucugguugaauuuaaggacgcccacgccaaacgccagacaguggucgugcucgggagccaggagggagcuguucauacggcccuggcgggcgcucuugaagccgagauggauggggccaagggccggcuguucuccggacaccucaagugcagacugaaaauggacaaacuucgccugaagggcgugagcuacucucucuguaccgcugccuuuacauucaccaagguccccgcugagacacugcaugggaccgugacgguggaaguucaguaugccggaaccgauggcccgugcaaagucccugcgcaaauggccguggacaugcagacacugacccccguggggcggcucauuacagcuaauccugucaucaccgaguccacggaaaacagcaagaugaugcuggagcuugacccucccuuuggagauucuuacauugugaucggcguuggggacaagaaaaucacacaccacuggcauagauccggcagcaccauuggaaaggccuucgaagcuacagugcgcggcgccaaacggauggcgguccugggggauaccgccugggacuucggauccgugggcgggguuuuuaacucucucggaaagggcauccaccagauuuucggggcugccuuuaaaagccuguucggcggaauguccugguuuucucaaauccugauuggcacccuucucguguggcuggggcugaauacaaagaacggaagcaucucccucacgugucuggcucuuggcggggucaugaucuuccugagcaccgccgugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6830 - RNA, 2449 nt, Artificial Sequence
  KF383118.1 prME-short mRNA Design 2 opt
ggggcgcugccuacggagguggcagccaucuccuucucggcaucaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaaccugaugacguggauuguuggugcaauaccacaucuaccuggguggucuacgggacgugucaccauaagaaaggagagaccagacggagccgcagauccgugucucuucgguaucacuacacacgcaagcugcaaaccagaagccagacauggcucgaaucccgggaguauaaaaagcaucugaucaugguugagaacuggaucuuucgcaauccgggcuucgccauugugagcgucgcuaucaccuggcugaugggcucucucacgucccagaaggugauuuaccugguuaugaucgugcuuauuguccccgccuacagcaucucuugcauugggguguccaacagagaccugguggaaggaaugagcggcgggacaugggucgauguugugcucgagcacggaggcugugugaccgaaauggcgcaggacaaaccuacagucgauaucgagcuggugaccaugaccguuucuaauauggccgaggugcgguccuauugcuacgaagcuagccuuuccgacauggccucugcuagccgcugucccacacaaggggagccuucccuggauaagcagagcgacacgcagucugucugcaaaagaacccucggagaccggggcuggggcaacggguguggaaucuuuggcaaggggucccuggugacaugcagcaaauuuaccugcuguaagaagaugcccggaaaaucuauucagccugaaaaucuggaguaucgcaucaugcucccgguucacggcagccaacauuccgggaugauugugaacgauaucggacacgaaacagacgagaauagagccaaggucgaggugacccccaacucuccucgggcggaagccacgcugggcggcuuugggagccuuggacuggauugcgagcccagaacaggccucgacuucuccgaucuguacuaucuuaccaugaauaacaaacauuggcugguccacaaggaaugguuucacgacauuccucuccccuggcaugcuggggccgauaccggaacaccgcacuggaauaacaaagaggcucugguggaguucaaggacgcccaugccaaacgccagaccguugugguccugggcagccaggaaggggcugugcacacagcgcucgccggcgcucuggaggccgaaauggauggagccaagggccggcuuuucucugggcaucugaaguguagacucaaaauggacaagcugcgccuuaaaggaguuuccuacagccugugcacggcugccuucaccuuuacaaaggugccugcggagacccuccacggcacagucaccguggaagugcagucugcugggacggauggacccuguaaaguuccugcccaaauggccgucgacaugcagacccugacacccgugggccggcugaucaccgcuaaucccgugaucacagaguccaccgaaaacagcaagaugaugcucgagcuggacccuccguucggggauuccuauauugucaucggcgugggagacaagaaaauuacgcaccauuggcacagaucuggcagcacaaucgggaaggccuuugaggcuaccguucgcggagccaaacggauggcggugcuuggcgauacagccugggacuucggguccgucggaggcguguucaacucucuggggaagggcauucaucagaucuuuggagcugccuucaaaagccucuuuggcgggauguccugguucagccaaauccugauuggaacccugcuuguuuggcucggccugaauaccaagaacgggucuaucucccugacaugccucgcucugggaggcgugaugauuuuucuuagcacggccgucucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6831 - RNA, 2446 nt, Artificial Sequence
  KX447520.1 prME-short mRNA Design 2 opt
ggggcgcugccuacggagguggcagccaucuccuucucggcaucaagcuuaccaugagcgugggcaucgucgggcugcuccugaccacagccauggcugccgagguuacgagacggggauccgcguacuauauguaccuugaccgcaacgaugcuggcgaagccauuucuuuccccaccacacuggggaugaauaagugcuauauccagauuauggaccucggacacaugugugaugccaccaugagcuacgagugcccuaugcuggacgaaggcguggagccggaugacguggauuguuggugcaacacaaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6832 - RNA, 2449 nt, Artificial Sequence
  KU761561.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggcccggcgcauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6833 - RNA, 2449 nt, Artificial Sequence
  KX806557.2 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauguuucgcaacccuggcuucgcucuggccgcggccgcuauugccuggcuccugggcuccagcacgucucagaaagucaucuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaauuaugcugucugugcacggaucccaacacagcggcaugaucguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacauugucaucggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuauugggacacuccugauguggcugggacucaacacgaagaauggcagcaucucccugaugugucuugcucuugggggaguucucaucuuccugagcaccgcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6834 - RNA, 2449 nt, Artificial Sequence
  LC191864.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaugaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6835 - RNA, 2449 nt, Artificial Sequence
  KU744693.1 prME-short mRNA Design 2 opt
ggggcgcugccuacggagguggcagccaucuccuucucggcaucaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccgcgauggcccaggacaagccuacaguugauauugagcuugugaccaccacaguguccaacauggcugagguccgcagcuacugcuaugaagccucuaucuccgacauggcuagcgauuccagaugucccacgcaaggggaggccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauucagccugaaaaccucgaguacagaaucaugcugucuguccacggaucccaacacagcggcaugcuugugaaugacaccgggcaugaaacggaugagaaccgggcgaagguugagaucacaccgaauagccccagagccgaagcuacccugggaggcuucggcagccucgggcuggacugugagccucgcaccggacuugauuuuuccgaccuguauuaccucacaaugaacaauaaacacuggcuggcccauaaggaaugguuccacgauauuccccugccuuggcacgccggcgcugccaccgggacaccccauuggaacaauaaagaggcgcucguggaauuuaaggacgcucacgccaaacggcagacggucgugguccugggaucucaggagggcgccgugcauaccgcucuugccggggcucuggaggccgaaauggauggcgcgaagggaagacucagcuccggccaccugaaaugccgccuuaagauggacaagcugcggcucaaagggguuagcuauucucuguguacagccgcuuucaccuuuacaaagaucccggccgagaccguggauggaacggucaccguggaaggccaguacgggggaacagacggcccuugcaaaguucccgcucaaauggccguggacaugcagacccugacaccugucgggagacucauuaccgcgaaccccgugaucacggaguccacagaaaacagcaagaugaugcuggagcuugaucccccuuucggcgacucuuacauugugaucggaguuggcgagaaaaagaucacccaucacuggcaccgcuccgggagcacaauuggaaaggccuuugaagcuaccguccggggcgccaaaagaauggcugugcugggggauaccgccugggacuucggauccgugggcggggcccucaauucucugggcaagggaauccaucagauuaucggcgcugcguucaaaagccuguuugggggaauguccugguucucucaaauucuuaucggcacacuccugauguggcuggggcucaacacgaagaauggaagcaucucccugaugugucuugcccugggcgggguccucauuuuucugagcaccgcugugucuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6836 - RNA, 2440 nt, Artificial Sequence
  KU963574.2 prME-short mRNA Design 2 opt
ggggcgcugccuacggagguggcagccaucuccuucucggcaucaagcuuaccaugggcgccgacgcuagcaucgggauugugucccugcuccugaccacagucauggccgcggagaucacgagacggggaucugcuuacuauauguaccuugaucgcagcgacgccggcaaggccauuuccuucguuaccacacugggggugaacaaaugccacgugcagaucauggaucucggacauaugugugacgcuaccaugucuuaugaaugccccaugcuggaugagggcgucgaacccgacgauguggacuguuggugcaauacaaccagcacauggguuguguacgggaccugucaccauaagaaaggagaggccagacggucccgcagagcugucacgcuuccgucucacagcacccggaagcugcaaacacgcucccagaccuggcucgaaagcagagaguauacaaaacaucugauuaagguggagaacuggaucuuucggaaucccggcuucgcccugguugcgguggccaucgcuuggcuccugggaucuuccaccagccagaaggucauuuaccuugugaugauccugcucauugccccugcuuauucuauccgcugcauugggguguccaacagagauuuugucgaaggaaugagcggcgggacguggguugacguggugcuggagcacggaggcugugucacagugauggcccaggauaaacccaccguugacaucgaacuugugacaaccaccgucucuaauauggcggaggugcgguccuacugcuacgaggccagcauuuccgauauggcuucugacagccgcuguccuacacaaggggaagccuaucuggacaagcaguccgauacgcaguacguuugcaaaagaacccucguggaccggggauggggcaacggcugugggcuguucggaaagggcagccuggucacaugcgcuaaauuuaccugcucuaagaagaugacagggaaauccauccagcccgagaaucucgaauaucgcaucaugcugagcgugcacggaucucaacauagcggcaugauugucaacgaugagaauagagccaagguggaaguuaccccuaacuccccgcgggccgaggcuacgcuugggggauucggcucucugggccucgacugugagcccagaacagggcuggauuuuagcgaccuuuacuaucugaccaugaauaacaaacacuggcucgugcauaaggaaugguuccacgauaucccucugcccuggcacuccggagcggacaccgagacaccucauuggaauaacaaagaagcccuggucgaguuuaaggaugcucacgccaaacgccagaccgugguugugcucggcagccaggaaggggccguccauacagcucuggccggagcgcuugaggcugagauggacggcgccaaggggcggcugucuuccggccaccucaagugcagacugaaaauggauaaacuucgccugaagggagugagcuacucucucuguacggccgcuuucaccuuuacaaaggugcccgccgaaacccugcauggcacaguuaccgucgaggugcaguaugcugggcgggacggaccgugcaaagugccugcccaaauggcggucgacaugcagacgcugacccccgugggcagacucauuacagccaauccuguuaucaccgaauccacagagaacagcaagaugaugcuggaacuugauccucccuucggggacuccuacauugugaucggagucggcgauaagaaaaucacccaccacuggcaucgcucugggagcauuaucggcaaggcuuuugaggccacggugcggggagcuaaaagaauggccguucugggcgacacagcgugggauuucggguccgugggaggcgucuucaacucucucgggaagggcauucaccagaucuuuggcgccgcuuucaaaagccuguuugggggcauguccugguucagccaaauucugaucggaacccuucucguguggcugggccugaauacaaagaacgggucuaucucccucaccugucuggcccuuggaggcguuaugauuuuucugagcaccgcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6837 - RNA, 2458 nt, Artificial Sequence
  KF383120.1 prME-short mRNA Design 2 opt
ggggcgcugccuacggagguggcagccaucuccuucucggcaucaagcuuaccaugggcgccgacaccagcaucgggauuaucggacugcuccugacaacggcuauggccgcggagauuaccagacggggcuccgcuuacuauauguaccuugaucgcucugacgccgggaaggccaucagcuucgcuacaaccaugggagugaacaaaugccacguccagauuauggaucugggccauaugugugacgccacaauguccuaugaaugccccaugcucgaugaggggguugaaccugacgauguggacuguuggugcaauaccacaucuaccuggguggucuacggaacgugucaccauaagaaaggcgaggcuagaccgagccggcgcgccgugacccugcccucccacucuacaagaaaacuucaaacccggagccagacauggcuggaaucccgcgaguauaccaagcaucucaucaagguugagaacuggauccugagaaauccuggcuuuacgguggcggcccuggcuauggccuggcuccuggggaacagcacaucucagcgggucauuuaccuugugaugauccugcucauugcucccgccuauuccauccgcugcauuggaguuagcaauagagauuucguggaaggcaugucugggggaaccugggucgacguggugcuggagcacggcgggugugucacaguuauggcgcaggauaagccuaccguggacaucgaacuugugaccacaacggucuccaacauggccgaggugcggagcuacugcuacgaggcuucuauuuccgauauggccagcgacucccgcugucccacccaaggagaggcuuaucuggacaaacagucugauacacaguacguuugcaagagaacccucguggaccggggcuggggcaauggguguggacuguuuggcaaagggagccuggucacaugcgccaaguuuaccugcuccaaaaagaugacgggaaagagcauccagccugaaaaccucgaauaucgcaucaugcugucugugcacggcucccaacauagcgggaugauuguuaaugauaucggacacgagacagacgaaaacagagccaaaguggaggucacccccaauucuccccgggcugaggcgacccuuggcggcuucgggagccugggacucgauugugaaccuagaacaggccuggacuucuccgaucuuuacuaucugaccaugaacaauaagcauuggcucgugcacaaagagugguuucacgacauuccccugccuuggcaugccggggcugauacaggaacgccccacuggaacaauaaggaagcccuggucgaguucaaagacgcccaugcuaagcgccagaccgugguugugcucggcucucaggaaggggccguccacacagcgcuggcuggcgcccuugaggccgagauggauggagcuaaaggccggcuguuuagcgggcaucucaagugcagaaucaagauggacaaacugcgccuuaagggaguguccuacagccuguguaccgccgcuuucacauuuucuaaaguuccggccgaaacccuccacggcacggugaccgucgaggugcaguaugcggggcgggacggaccuugcaaggugcccgcccaaauggcuguugauaugcagacacugaccccugucggcagacugauuacagccaaccccaucaucaccgaauccacggagaacagccgcaugaugcucgaacuggacccgccuuucggggauucuuacauugugaucggcgugggagacaaaaagauuacacaccauuggcaccgguccggcagcaccaucgggaaggcuuuugaggccacagucagaggagcgaaacgcauggccgugcuuggcgauaccgcuugggacuucggguccguuggaggcguguucaauucucuggggaagggcguccaucagguguuuggagccgcuuucaaaagccucuuuggcgggauguccugguucucucaaauucugaucggaacccugcuuguuuggcucggccugaacacaaagaaugggagcaucucccuggccugucucgcccugggaggcgcuaugauuuuucuuagcacggcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6838 - RNA, 1741 nt, Artificial Sequence; identical to SEQ ID NO: 6613
  KU321639.1 solE mRNA Design 2 opt

SEQ ID NO: 6839 - RNA, 1741 nt, Artificial Sequence; identical to SEQ ID NO: 6614
  KU312312.1 solE mRNA Design 2 opt

SEQ ID NO: 6840 - RNA, 1729 nt, Artificial Sequence; identical to SEQ ID NO: 6615
  AY632535.2 solE mRNA Design 2 opt

SEQ ID NO: 6841 - RNA, 1741 nt, Artificial Sequence; identical to SEQ ID NO: 6614
  KU527068.1 solE mRNA Design 2 opt

SEQ ID NO: 6842 - RNA, 1741 nt, Artificial Sequence
  KX421193.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6843 - RNA, 1741 nt, Artificial Sequence
  LC002520.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugacaguuaacgauaucggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6844 - RNA, 1723 nt, Artificial Sequence
  DQ859059.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacgcgggggccgacacgggaacaccgcacuggaauaacaaagaagcucugguggaguucaaggacgcccaugcuaagcggcagaccguugugguccucggcagccaggaaggggccgugcacacagcgcuggccggagcucuggaggccgaaauggauggcgcuaaagggcgccucuuuuccggacaucugaaguguagacuuaaaauggacaagcugcggcucaaaggcguuucuuacagccugugcaccgccgccuucaccuuuacaaaggugcccgcugagacgcuucacggcaccgucacaguggagguccaauaugcggggaccgauggaccuuguaaagugcccgcccagauggcuguugacaugcagacacugaccccugugggccgccucaucacggccaaucccgucauuacagaauccaccgagaacagcaagaugaugcuggaacuggauccgccuuucggggacucuuacaucgugauuggaguuggcgauaagaaaaucacccaccauuggcacagauccgggagcacaaucggcaaggccuuugaggcuaccgugcggggagccaaacgcauggcgguccucggcgacacagcuugggauuucgggucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6845 - RNA, 1729 nt, Artificial Sequence
  KU963573.2 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugagaaccgggccaagguugaagugaccccuaauagcccccgcgcugaggccacacucgggggauuuggcucucugggccuggacugcgagccuagaaccgggcuugauuucuccgaccuguacuaccucacgaugaacaauaaacauuggcuggugcacaaggaaugguuucaugauauuccccuuccuuggcacgcgggagccgacacaggcaccccgcacuggaacaauaaagaggcucuggucgaguucaaggacgcccaugcuaagcggcagacagugguugugcucgggagccaggaaggagccguccacaccgcgcuggccggcgcucuggaagccgagauggauggggcuaaaggaaagcucuuuuccggccaucugaaaugucgccuuaagauggacaaacugagacucaagggcgugucuuauagccugugcaccgccgccuucacauuuacgaaaguucccgcugagacccuucacgggacagugaccgucgaagugcaauacgcgggaacagauggcccuuguaagauccccguccagauggccguggacaugcagacccugacgccuguugggcggcucauuacagcuaaccccgugaucaccgaguccaccgaaaauagcaagaugaugcuggagcuggauccgccuuucggagacucuuauauugucaucggcgugggggauaaaaagaucacacaccauuggcaccgcuccggcagcaccauuggaaaagccuuugaagccacaguuagaggcgcuaagcggauggccgugcucggggacacggcgugggauuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6846 - RNA, 1741 nt, Artificial Sequence
  KY075939.1 solE mRNA Design 2 opt
ggggcgcugccuacggagguggcagccaucuccuucucggcaucaagcuuaccaugagccagaaggugaucuaccuggucaugauucuccugaucgcccccgcuuauucccuuagaugcauuggcguuucuaaccgggacuucguggaggggaugagcggaggcaccuggguggaugucgugcuggaacacgggggauguguuacagugauggcccaagacaaaccuacggucgauaucgagcucgugaccacaaccguuuccaauauggcggaagugcgcucuuacugcuaugaggcuagcauuuccgacauggccucugauagcagauguccgacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaacccgagaaucuggaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuugauugcgagccuagaaccgggcuggacuucuccgaucucuauuaccugacgaugaauaacaaacacuggcuugugcauaaggaaugguuucacgacauuccccugccuuggcacgccggagcugacacaggcaccccgcauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauccccgcggagacccugcacgggacaguuaccguggaaguccaauaugccggaacagacggcccuuguaaagugcccgcucagauggccgucgauaugcagacccucacgccuguggggcgccugauuacagccaaucccguuaucaccgagagcaccgaaaacucuaagaugaugcuggagcucgacccgccuuuuggagauuccuacauugugaucggcgucggggaaaagaaaaucacacaucacuggcauagaagcggcucuaccauuggaaaggcuuucgaggccacagugcggggcgcgaaacgcauggcuguucugggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6847 - RNA, 1741 nt, Artificial Sequence
  KX447516.1 solE mRNA Design 2 opt
ggggcgcugccuacggagguggcagccaucuccuucucggcaucaagcuuaccaugagcaagaaagugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaggacaagccuacggucgauauugagcuggugaccacaaccguuuccaauauggcggaagugcgcucuuacugcuaugaggcuagcaucuccgacauggccucugauagcagauguccgacacaaggcgaagccuaccucgacaaacaguccgauacccaguaugucugcaagcggacacugguggaccgcggguggggaaacggcuguggccuuuuugggaaaggaagccuggugaccugcgcuaaguucgccuguucuaagaaaaugacgggcaaguccauccagcccgagaaucucgaguacagaauuaugcugagcguccaugggucucaacacuccggaaugaucguuaacgauaccggccaugaaacagacgagaaucgggcuaaaguggaaauuaccccuaacagcccccgcgccgaggcgacacucgggggauuuggcucucugggccuggauugcgagccuagaaccgggcuugacuucuccgaucuguauuaccucacgaugaauaacaagcacuggcuggugcauaaagaaugguuucacgacaucccccuuccuuggcacgccggagcugacacaggcaccccgcauuggaauaacaaggaggcccuggucgaguucaaggaugcucacgccaaacggcagacagugguugugcucgggagccaggaaggagcgguccauaccgcccuggcuggcgcccuggaagcugagauggacggggccaagggacgccucuccucuggccaccugaaauguagacuuaagauggauaaacugcggcucaagggcgugagcuacucccugugcaccgccgcuuuuacauucacgaaaauucccgcggagacccuucacgggacaguuaccguggaaguccaguaugccggaacagacggcccuuguaaggugcccgcucaaauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggagaaaaagauuacacaucacuggcauagaagcggcucuaccaucggaaaggcuuucgaagccacagugcggggcgcgaaacgcauggcuguucucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6848 - RNA, 1741 nt, Artificial Sequence
  KX447515.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacugguauagaagcggcucuaccaucggaaaggcuuucgaggccacagugcggggcgcgaaacgcauggcuguucucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6849 - RNA, 1741 nt, Artificial Sequence
  KU758874.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggaaagcucuccucuggccaccugaaaugucgccuuaagauggauaaacugagacucaagggcgugagcuacucccugugcaccgccgcuuuuacauucacgaaaauucccgcggagacccuucacgggacaguuaccguggaaguccaauaugccggaacagacggcccuuguaaggugcccgcucagauggccgucgauaugcagacccugacgccuguggggcggcucaucacagccaaucccguuauuaccgagagcaccgaaaacucuaagaugaugcuggagcuggacccgccuuuuggagauuccuacaucgugaucggcgucggggagaaaaagauuacacaucacuggcaucgcagcggcucuaccaucggaaaggcuuucgaagccacagugagaggcgcgaaacggauggcuguucucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6850 - RNA, 1741 nt, Artificial Sequence
  KU729218.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauacccagacgcugacaccuguggggcgccucaucaccgccaaucccguuauuaccgagagcacagaaaacucuaagaugaugcuggagcuggacccgccuuuuggagauuccuacaucgugaucggcgucggggaaaagaaaauuacccaucacuggcauagaagcggcucuacaaucggaaaggcuuucgaggccacggugcggggcgcgaaacgcauggcuguucucggggacaccgccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6851 - RNA, 1741 nt, Artificial Sequence
  KU501217.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaaauccgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6852 - RNA, 1741 nt, Artificial Sequence
  KU761561.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgcgcagaauggcuguucucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6853 - RNA, 1741 nt, Artificial Sequence
  KY075937.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggucucugauagcagauguccgacacagggcgaagccuaccucgacaagcaguccgauacccaguaugugugcaaacggacacugguggaccgcggguggggaaacggcuguggccuuuuugggaagggaagccugguuaccugcgccaaauucgcuuguucuaagaagaugacgggcaaauccauccaacccgagaaucucgaguacagaauuaugcugagcguccaugggucucagcacuccggaaugaucgugaacgauaccggccaugaaacagacgagaaucgggccaagguggaaauuaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6854 - RNA, 1741 nt, Artificial Sequence
  KY014317.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaucgaaaacucuaagaugaugcuggagcuggacccgccuuuuggagauuccuacaucgugauuggcgucggggaaaagaaaaucacccaucacuggcauagaagcggcucuacaauuggaaaggcuuucgaggccaccgugcggggcgcgaaacgcauggcuguucucggggacacagccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6855 - RNA, 1741 nt, Artificial Sequence
  KU870645.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcauuggggaaaagaaaaucacacaucacuggcauagaagcggcucuaccauuggaaaggcuuucgaggccacaguccggggcgcgaaacgcauggcugugcucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6856 - RNA, 1741 nt, Artificial Sequence
  KU922923.1 solE mRNA Design 2 opt
ggggcgcugccuacggagguggcagccaucuccuucucggcaucaagcuuaccaugagccagaaggugaucuaccuggucaugauucuccugaucgcccuugcuuauuccauuagaugcaucggcguuucuaaccgggacuucguggaggggaugagcggaggcaccuggguggaugucgugcuggaacacgggggauguguuacagugauggcccaagacaaacccacggucgauauugagcucgugaccacaaccguuuccaauauggcggaagugcgcucuuacugcuaugaggcuagcaucuccgacauggccucugauagcagauguccuacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaaccggagaaucuggaguacagaauuaugcugagcguccaugggucucagcacuccggaaugaucguuaacgauaccggccaugaaacagacgagaaucgggcuaagguggaaauuacccccaacagcccucgcgccgaggcgacacucgggggauuuggcucucugggccuugauugcgagcccagaaccgggcuggacuucuccgaucucuauuaccugacgaugaauaacaaacacuggcuugugcauaaggaaugguuucacgacaucccucugcccuggcacgccggagcugacacaggcaccccucauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauuccggcggagacccugcacgggacaguuaccguggaaguccaauaugccggaacagacggccccuguaaagugccugcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6857 - RNA, 1741 nt, Artificial Sequence
  KU497555.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggacccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcacagccgcuuuuacguucaccaagauucccgcggagacacuucacgggaccguuacaguggaaguccaauaugccggaaccgacggcccuuguaaagugcccgcucagauggccgucgauaugcagacgcugacaccuguggggcgccucaucaccgccaaucccguuauuaccgaguccacagaaaacagcaagaugaugcuggagcuggacccgccuuuuggagauucuuacaucgugaucggcgucggggaaaagaaaauuacccaucacuggcauagauccggcagcacaaucggaaaggcuuucgaggccacggugcggggcgcgaaacgcauggcuguucucggggacaccgccugggauuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6858 - RNA, 1741 nt, Artificial Sequence
  KU312314.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcuggcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6859 - RNA, 1741 nt, Artificial Sequence
  KY014314.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaagcucacgccaagcggcagacagugguugugcucgggagccaggaaggagcgguccauaccgcccuggcuggcgcccuggaggcugagauggauggggccaaaggacgccucuccucuggccaccugaaguguagacuuaaaauggacaagcugcggcucaaaggcgugagcuacucccugugcaccgccgcuuuuacauucacgaagauucccgcggaaacccuucacgggacaguuaccguggagguccaauaugccggaacagauggcccuuguaaagugcccgcucagauggccgucgacaugcagacccugacgccuguggggcgccucaucacagccaaucccguuauuaccgaaagcaccgagaacucuaagaugaugcuggaacuggauccgccuuuuggagacuccuacaucgugaucggcgucggggagaagaaaauuacacaucacuggcauagaagcggcucuaccaucggaaaggcuuucgaggccacagugcggggcgcgaaacgcauggcuguucucggggauacggccugggacuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6860 - RNA, 1741 nt, Artificial Sequence
  KX447517.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcggcccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6861 - RNA, 1741 nt, Artificial Sequence
  KU729217.2 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcugguguccaccacaguuucuaauauggcggaagugcgcagcuacugcuaugaggcuaccaucuccgacaucgccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauucaacccgagaaucucgaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccuggucgaguucaaggaugcucacgccaagcggcagacagcggugguucucgggagccaggaaggagccgugcauaccgcucuggccggcgcucuggaagccgagauggacggggccaaaggacgccucuccucuggccaccugaaguguagacuuaaaauggauaagcugcggcucaaaggcgucagcuacucccugugcaccgcugcguuuacauucacgaagauccccgccgagacccuucacgggacagugaccguugaagugcaauaugcuggaacagacggcccuuguaaaguccccgcccagauggccguggauaugcagacccugacgccugucgggcgccucauuacagcuaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggccuucgaggcgacaguccggggcgcuaaacgcauggccgugcucggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6862 - RNA, 1741 nt, Artificial Sequence
  KY328290.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucagcaagauucccgcggagacgcuucacgggaccguuacagaagaggugcaauaugccggaaccgacggcccuuguaaaguccccgcucagauggccguggauaugcagacacugaccccugucgggcgccucaucacggccaaucccgugauuacagaaucuaccgagaacuccaagaugaugcuggaacuggacccgccuuuuggagauagcuacaucguuaucggcgugggggagaagaaaauuacccaucacuggcauagaucuggcagcacaaucggaaaggcuuucgaggccaccguccggggcgcgaaacgcauggcugugcucggggacacagccugggauuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6863 - RNA, 1741 nt, Artificial Sequence
  KX087101.3 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaacugcaauaugccggaacagacggcccuuguaaaguccccgcucagauggccguggauaugcagacccucacgccugucgggcgccugaucacagccaaucccgugauuaccgagagcaccgaaaacucuaagaugaugcuggagcucgacccgccuuuuggagauuccuacaucguuaucggcgugggggaaaagaaaauuacacaucacuggcauagaagcggcucuaccaucggaaaggcuuucgaggccacaguccggggcgcgaaacgcauggcugugcugggggacacggccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6864 - RNA, 1741 nt, Artificial Sequence
  KY003156.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcauuucuaaccgggacuucguugaggggaugagcggaggcaccuggguggaugugguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcauucugggccuggauugcgagccuagaaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccugguggaguucaaggaugcucacgccaagcggcagacagucgugguucucgggucccaggaaggagcggugcauaccgcccuggcuggcgcccuggaagcugagauggacggggccaaaggacgccucagcuccggccaccugaaguguagacuuaaaauggauaagcugcggcucaaaggcgucucuuacagccugugcaccgccgcuuuuacauucacgaagauucccgcggagacccuucacgggacagugaccguugaagugcaauaugccggaacagacggcccuuguaaaguccccgcucagauggccguggauaugcagacccugacgccugucgggcgccucaucacagccaaucccgugaucaccgaguccaccgaaaacagcaagaugaugcuggagcuggacccgccuuuuggagauucuuacauuguuaucggcgugggggaaaagaaaauuacacaucacuggcauagauccggcagcaccaucggaaaggcuuucgaggccacaguccggggcgcgaaacgcauggcugugcucggggacacggccugggauuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6865 - RNA, 1741 nt, Artificial Sequence
  KU758876.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggugaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6866 - RNA, 1741 nt, Artificial Sequence
  KU926310.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggagcugacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6867 - RNA, 1741 nt, Artificial Sequence
  KU681081.3 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacacaggagccgacaccggcacaccgcauuggaauaacaaagaggcucuggucgaguucaaggaugcccacgcuaagcggcagaccgugguugugcucgggagccaggaaggagccguccauaccgcgcuggccggcgcucuggaagccgagauggacggggcuaaaggacgccucuccucuggccaccugaaguguagacuuaaaauggauaagcugcggcucaaaggcgugagcuacucccugugcacagccgccuuuacguucaccaagauucccgcugagacacuucacgggaccguuacaguggaaguccaauaugcgggaaccgacggcccuuguaaagugcccgcccagauggcugucgauaugcagacgcugacaccuguggggcgccucaucaccgccaaucccguuauuaccgagggaacagaaaacagcaagaugaugcuggagcuggacccgccuuuuggcgauucuuacaucgugaucggggucggcgaaaagaaaauuacccaucacuggcauagauccggaagcacaaucggcaaggccuucgaggcuacggugcgcggggccaaacggauggcgguucucggagacaccgcuugggauuuuggcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6868 - RNA, 1741 nt, Artificial Sequence
  KU744693.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagccauggcgcaagacaaaccuacgguggauauugagcuggucaccacaaccguguccaauauggcugaaguucgcucuuacugcuaugaggccagcaucuccgacauggccucugauagcagauguccgacacagggcgaggcuuaccucgacaagcaguccgauacccaguaugugugcaaacggacacuggucgaccgcggguggggaaacggcuguggccuuuuugggaagggaagccuggugaccugcgccaaauucgcuuguucuaagaagaugacgggcaaauccauccaacccgaaaaucucgaguacagaauuaugcugagcgugcaugggucucagcacuccggaaugcuggucaacgauaccggccaugaaacagacgagaaucgggccaagguugaaaucaccccuaacagcccccgcgcggaggccacacucgggggauuuggcucucugggccuugauugcgagccuagaaccgggcuggacuucuccgaucucuauuaccugacgaugaauaacaaacacuggcuugcucauaaggaaugguuucacgacauuccccugccuuggcacgccggagcugccacaggcaccccgcauuggaauaacaaagaggcgcucguggaguucaaggacgcccacgcuaagcggcagacaguggucgugcuggggagccaggaaggagccguucauaccgcucuggccggcgcccucgaagcugagauggauggggcgaaaggacgccuguccucuggccaccuuaaguguagacugaaaauggacaagcuccggcugaaaggcgugagcuacucccuuugcaccgccgcuuuuacauucacgaagauccccgccgagaccgucgaugggacagugaccguugaaggacaauauggcgggacagacggaccuuguaaagugcccgcccagauggcugucgauaugcagacccugacgccugugggccgccucauuacagccaaucccgucaucaccgagagcaccgaaaacucuaagaugaugcuggagcuggacccgccuuuuggggauuccuacauugugaucggcguuggagaaaagaaaaucacacaccauuggcacagaagcggcucuaccauugggaaggcguucgaggcuacagugcggggagccaaacgcauggccguccucggcgacacggcuugggauuuugggagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6869 - RNA, 1741 nt, Artificial Sequence
  EU545988.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccugcggucgauauugagcuggugacgaccacaguuuccaauauggcugaagugcgcucuuacugcuaugaggccagcaucuccgacauggccucugauagcagauguccgacccagggcgaggcuuaccucgacaagcaguccgauacacaguaugucugcaaacggacccugguggaccgcggguggggaaacggcuguggccuuuuugggaagggaagccuggugacaugcgccaaauucgcuuguucuaagaagaugaccggcaaauccauccaacccgaaaaucucgaguacagaauuaugcugagcguccaugggucucagcacuccggaaugaucguuaacgauacgggccaugaaaccgacgagaaucgggccaagguggaaauuacaccuaacagcccccgcgcggaggccacccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6870 - RNA, 1741 nt, Artificial Sequence
  KY007221.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuaacaaucgggacuucguggaggggaugucuggaggcaccuggguggaugucgugcuugaacacgggggauguguuacagugauggcccaagacaaaccuacggucgauauugagcuggugaccacaaccguuagcaacauggcggaagugcgcuccuacugcuaugaggcuucuaucagcgacauggccuccgauucuagauguccgacacagggcgaagccuaccucgacaagcagagcgauacccaguaugucugcaaacggacacugguggaccgcggguggggaaauggcuguggccuuuuugggaagggaucccuggugaccugcgcuaaauucgccuguagcaagaagaugacgggcaaaucuauccaacccgagaaccucgaguacagaauuaugcuguccguccaugggagccagcacucuggaaugaucguuaaugauaccggccaugaaacagacgagaaccgggcuaagguggaaauuaccccuaauagcccccgcgccgaggcgacacucgggggauuuggcucccugggccuggauugcgagccuagaaccgggcuugacuucucugaucuguauuaccucacgaugaacaauaaacacuggcuggugcauaaggaaugguuucacgacaucccccuuccuuggcacgccggagcugacacaggcaccccgcauuggaacaauaaagaggcccuggucgaguucaaggaugcucacgccaagcggcagacagugguugugcucgggucccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaccccguuauuaccgaguccaccgaaaauagcaagaugaugcuggagcuggacccgccuuuuggagauucuuacaucgugaucggcgucggggaaaagaaaauuacacaucacuggcauagauccggcagcaccaucggaaaggcuuucgaggccacagugcggggcgcgaaacgcauggcuguucucggggacacggccugggauuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6871 - RNA, 1741 nt, Artificial Sequence
  KY003152.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcgccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6872 - RNA, 1741 nt, Artificial Sequence
  KX694533.2 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauauuggccaugaaaccgacgagaaucgggcuaagguggaaaucacaccuaacagcccccgcgccgaggcgacccucgggggauuuggcucucugggccuggauugcgagccuagaacagggcuugacuucuccgaucuguauuaccucaccaugaauaacaaacacuggcuggugcauaaggaaugguuucacgacauuccccuuccuuggcacgccggagcugacacgggcacaccgcauuggaauaacaaagaggcccuggucgaguucaaggaugcucacgccaagcggcagaccgugguugugcucgggagccaggaaggagcgguccauacagcccuggcuggcgcccuggaagcugagauggacggggccaaaggacgccucuccucuggccaccugaaguguagacuuaaaauggauaagcugcggcucaaaggcgugagcuacucccugugcaccgccgcuuuuaccuucacaaagauccccgcggagacgcuucacgggaccguuacaguggaaguccaauaugccggaaccgacggcccuuguaaagugcccgcucagauggccgucgauaugcagacacugaccccuguggggcgccucauuacggccaaucccguuaucacagagagcaccgaaaacucuaagaugaugcuggagcuggacccgccuuuuggagauuccuacaucgugauuggcgucggggacaagaaaaucacccaucacuggcauagaagcggcucuacaauuggaaaggcuuucgaagccaccgugcggggcgcgaaacgcauggcuguucucggggauacagccugggacuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6873 - RNA, 1741 nt, Artificial Sequence
  KX601167.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggacaagaaaauuacacaucacugguauagaagcggcucuaccaucggaaaggcuuucgaagccacagugcggggcgcgaaacgcauggcuguucucggggauacggccugggacuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6874 - RNA, 1741 nt, Artificial Sequence
  KY288905.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggccaugaaaccgacgagaaucgggccaagguggaagugacaccuaacagcccccgcgcugaggccacccucgggggauuuggcucucugggccuggauugcgagccuagaacggggcuugacuucuccgaucuguauuaccucacaaugaauaacaaacacuggcugguccauaaggaaugguuucacgacauuccccuuccuuggcacgcgggagccgacaccggcacaccgcauuggaauaacaaagaggcucugguggaguucaaggaugcccacgcuaagcggcagaccguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcacagccgccuucacguuuaccaaggugcccgcugagacacuucacgggaccgucacaguggaaguccaauaugcgggaaccgacggcccuuguaaagugcccgcccagauggcuguugauaugcagacgcugacaccuguggggcgccucaucaccgccaaucccgucauuaccgaguccacagaaaacagcaagaugaugcuggagcuggacccgccuuucggagauucuuacaucgugauuggcguuggggacaagaaaaucacccaucacuggcauagauccggcagcacaaucggaaaggccuuugaagcuacggugcggggcgccaaacgcauggcgguccucggggauaccgcuugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6875 - RNA, 1741 nt, Artificial Sequence
  KF268950.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccgccuucacauuuacgaaggugcccgcugagacccuucacgggacagucaccguggaaguccaauaugcgggaacagacggcccuuguaaagugcccgcccagauggcuguugauaugcagacccugacgccuguggggcgccucauuacagccaaucccgucaucaccgaguccaccgaaaacagcaagaugaugcuggagcuggacccgccuuucggagauucuuacauugugaucggcguuggggacaagaaaaucacacaucacuggcauagauccggcagcaccauuggaaaggccuuugaagcuacagugcggggcgccaaacgcauggcgguccucggggauacggcuugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6876 - RNA, 1741 nt, Artificial Sequence
  KF383116.1 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccguguguacagccgcuaagguccccgcggagacgcuucacgggaccgugacagucgaagugcaauaugccggaaccgacggcccuugcaaaguucccgcucagauggccguggauaugcagacacugaccccugucgggcgccucauuacggccaaucccgugaucacagaguccaccgaaaacagcaagaugaugcuggagcuggacccgccuuucggagauucuuacauuguuaucggcgugggggacaagaaaaucacccaucacuggcauagauccggcagcacaauuggaaaggcuuuugaagccaccguccggggcgcgaaacgcauggcugugcucggggauacagccugggacuucggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6877 - RNA, 1723 nt, Artificial Sequence
  KU963574.2 solE mRNA Design 2 opt
ggggcgcugccuacggagguggcagccaucuccuucucggcaucaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacagcggggcggacacggaaacaccgcacuggaauaacaaagaggcccugguggaguucaaggacgcucaugccaagcggcagaccguugugguccucggaucccaggaaggcgcugugcacacagcccuggcgggggcccuggaagcugagauggauggagccaaaggccgccucucuagcgggcaucugaaguguagacuuaaaauggacaagcugcggcucaaaggaguuuccuacagccugugcaccgcugccuuuaccuucacaaaggugcccgccgagacgcuucacggcaccgucacaguggaaguccaauaugcuggccgcgaugggccuuguaaagugcccgcgcagauggccguugacaugcagacccugacaccugugggaagacucaucaccgcuaaucccgucauuacggagucuacagaaaacuccaagaugaugcuggagcuggauccgccuuuuggcgacagcuacaucgugauugggguuggagauaagaaaaucacccaccauuggcaccggucuggcagcaucauugggaaggccuucgaagccaccgugcgcggcgcuaaaagaauggccguccucggagacacagcgugggauuuuggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6878 - RNA, 1741 nt, Artificial Sequence
  KF383118.1 solE mRNA Design 2 opt
ggggcgcugccuacggagguggcagccaucuccuucucggcaucaagcuuaccaugagccagaaggugaucuaccuggucaugauuguucucaucgugcccgccuauuccauuucuugcaucggcgugagcaacagagaccuggucgaggggauguccggaggcaccuggguggauguugugcuugaacacgggggaugugucacagagauggcucaagacaaaccuacgguggauauugaacugguuaccaugacagugucuaauauggccgagguccggagcuacugcuaugaagcgucccucucugacauggcuagcgccucccgcuguccgacccagggcgagcccagccuggauaagcagucugacacacaguccgugugcaaaagaacccuuggggaucggggauggggcaacggcugugggaucuucggaaagggcagccuggugacaugcucuaaauuuaccuguugcaagaagaugccugggaaauccauccaacccgagaaucucgaauaccgcauuaugcugccuguccauggaagccagcacucuggcaugaucguuaacgacauugggcaugagacggaugaaaauagagccaagguggaggugacccccaacuccccucgggcugaggccacacugggaggcuucggcagccucgggcuggacugugaaccgcgcaccggacuugauuuuuccgaccuguauuaccucacaaugaauaacaaacacuggcugguccauaaggagugguuccacgauaucccccuuccuuggcacgcuggcgccgacaccgggacgccccauuggaauaacaaagaagcgcugguggaguuuaaggacgcccacgcuaagagacagacaguugugguccucggaucucaggaaggcgccgugcauaccgcucuggccggggcgcuggaggccgagauggauggagcuaaaggccgccucuucagcggccaccugaagugccggcuuaaaauggacaagcugagacucaaagggguuuccuauagccuguguacagccgcuuuuaccuucaccaaggugccugccgaaacacuucacggaacggucaccguggagguccaaucugccggcacagaugggcccugcaaagugccggcucagauggcgguugacaugcagacccugacaccugugggacggcucauuaccgccaaucccgucaucacggaauccacagagaacagcaagaugaugcuggaacuggauccucccuuuggcgacucuuacauugugaucgggguuggcgauaagaaaaucacccaucacuggcaucgcagcggauccaccauuggcaaggcuuucgaggccacagugagaggggccaaacggauggcuguccucggagacaccgccugggauuuuggcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6879 - RNA, 1741 nt, Artificial Sequence
  KX520666.1 solE mRNA Design 2 opt
ggggcgcugccuacggagguggcagccaucuccuucucggcaucaagcuuaccaugagacagaaggugaucuaccuggucaugauucuccugaucgcccccgcuuauagcauucggugcaucggcguuuccaaccgcgacuucguggaggggaugucuggaggcaccuggguggaugucgugcuugaacacgggggauguguuacagugauggcccaagacaaaccuacggucgauauugagcuggugaccacaaccguuagcaauauggcggaagugagauccuacugcuaugaggcuucuaucagcgacauggccuccgauucucgguguccgacacagggcgaagccuaccucgacaagcagagcgauacccaguaugucugcaaacgcacacugguggacagaggguggggaaacggcuguggccuuuuugggaagggaucccuggugaccugcgcuaaauucgccuguagcaagaagaugacgggcaaaucuauccaacccgagaaucucgaguaccggauuaugcuguccguccaugggagccagcacucuggaaugaucguuaacgauaccggccaugaaacagacgagaaucgcgcuaagguggaaauuaccccuaacucccccagagccgaggcgacacucgggggauuuggcagccugggccuggauugcgagccucggaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcgccagacagugguugugcucgggucccaggaaggagcgguccauaccgcccuggcuggcgcccuggaagcugagauggacggggccaaaggaagacucagcuccggccaccugaagugucggcuuaaaauggauaagcugcgccucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggagacucaucacagccaaucccguuauuaccgaguccaccgaaaacagcaagaugaugcuggagcuggacccgccuuuuggagauucuuacaucgugaucggcgucggggaaaagaaaauuacacaucacuggcaucgguccggcagcaccaucggaaaggcuuucgaggccacagugcgcggcgcgaaaagaauggcuguucucggggacacggccugggauuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6880 - RNA, 1741 nt, Artificial Sequence
  KF383120.1 solE mRNA Design 2 opt
ggggcgcugccuacggagguggcagccaucuccuucucggcaucaagcuuaccaugagccagagagugaucuaccuggucaugauucuccugaucgcccccgcuuauuccauucggugcaucggcguuucuaaccgcgacuucguggaggggaugagcggaggcaccuggguggaugucgugcuugaacacgggggauguguuacagugauggcccaagacaagccuacggucgauauugagcuggugaccacaaccguuuccaauauggcggaagugagaucuuacugcuaugaggcuagcaucuccgacauggccucugauagccgguguccgacacagggcgaagccuaccucgacaaacaguccgauacccaguaugucugcaagcgcacacugguggacagaggguggggaaacggcuguggccuuuuugggaaaggaagccuggugaccugcgcuaaguucacguguucuaaaaagaugaccggcaaguccauccaacccgagaaucucgaguaccggauuaugcugagcguccaugggucucagcacuccggaaugaucguuaacgauauuggccaugaaacagacgagaaucgcgccaaaguggaagugaccccuaacagccccagagcugaggccacacucgggggauuuggcucucugggccuggauugcgagccucggaccgggcuugacuucuccgaucuguauuaccucacgaugaauaacaagcacuggcugguccauaaagaaugguuucacgacaucccccuuccuuggcacgcgggagccgacacaggcaccccgcauuggaauaacaaggaggcucugguggaguucaaagaugcccacgcuaagcgccagacaguugugguccucgggagccaggaaggagccgugcauaccgcgcuggccggcgcucuggaagccgagauggacggggcuaagggaagacucuuuuccggccaccugaaaugucggauuaagauggauaaacuucgccugaagggcguuucuuacagccucugcaccgccgccuucacauuuuccaaagugcccgcugagacgcugcacgggaccgucacaguggaaguccaauaugcgggaagagacggcccuuguaaggugcccgcccagauggcuguugauaugcagacccuuacaccuguggggcggcugaucaccgccaaucccauuaucacggagagcacagaaaacucucgcaugaugcucgagcuggacccgccuuucggagauuccuacaucgucauuggcgugggggacaaaaagaucacccaucacuggcauagaagcggcucuaccauuggaaaggccuuugaagcuacaguucggggcgccaaaagaauggcggugcugggggauaccgcuugggacuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6881 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugaggauaauaaaugccagaaaggaaaaaaaaagaagaggagcugauacaaguguaggaauaguaggauuauuauugacaacagcaauggcagcugaaguaacgagaagagguucagcauauuauauguacuuagacaggaaugaugcaggugaagcaauaucauucccaacaacacuaggaaugaauaaauguuauauacaaauuauggaccucggacauaugugugaugcuacgaugucauaugaaugcccuaugcuggacgagggaguugaaccagaugauguugauuguuggugcaacacaacaaguacaugggucguauauggaacaugucaucauaaaaaaggagaagcacgaaggaguagaagagcuguaacauuaccaucacauucaacgcgaaagcuacaaacgcgaucacaaacaugguuagaaagcagagaauacaccaaacaucuaauuagaguagagaauuggauuuuuagaaauccaggauuugcacuggcggccgcugcaauugcauggcuauuaggaaguucaaccagucaaaaaguaauauaccuaguaaugauauuacuaauagcgccagcuuauagcauaagaugcauaggaguuaguaaccgagauuuugucgagggaaugucaggugguacuuggguagacauagugcuagaacaugguggauguguaacaguuauggcacaggacaaaccaacaguagacauugaacucguaacaacaacuguaaguaauauggcagaaguacggucauacuguuaugaagcuaguauaucagauauggcaagcgacagcagaugcccaacucaaggggaagcauacuuagauaaacaaagugauacucaguauguauguaaacgaacauuaguagacagaggauggggaaacggauguggacuuuucgguaaagguagccuagugacaugugcaaaauuugcuuguaguaaaaaaaugacuggaaaaucaauacaacccgaaaaucuagaauauagaauaauguugucaguccacggaucacagcauucugguaugauuguaaaugauacuggacaugaaacagaugaaaauagagcaaaaguagaaauaacaccaaacaguccaagggcagaagcaacauuaggugguuuuggaucacuaggguuagauugugaaccaaggacgggauuagauuuuagcgacuuauacuauuuaaccaugaacaauaaacacugguuaguacacaaagaaugguuucacgauauaccguugccguggcaugcgggagcugauacaggcacaccacauuggaauaauaaagaagcccuaguagaauucaaagacgcacacgcgaaaagacaaacaguaguaguauuagguucgcaagaaggcgcagugcauaccgcauuggcaggugcauuggaagcagaaauggauggagcaaaaggaagguuaaguucuggacauuugaaauguagauugaaaauggauaaacuaagacuaaaaggagugagcuauucauuauguaccgcagcauuuacauucacaaaaauuccagcagaaacguuacacggaacaguuacgguagaaguacaauaugcagggacagauggccccuguaaaguaccagcucaaauggcgguugauaugcaaacccuaaccccagugggaagauuaauuacagcuaacccaguaauaacagaaaguaccgaaaauagcaaaaugaugcuugaacuagacccaccauuuggagauucauacauaguaauaggaguuggagaaaaaaagauaacacaucauuggcauaggaguggaaguacuaucggaaaagcguuugaagcgacaguuagaggagcaaaaagaauggcuguguuaggggauacagcaugggauuuuggaagcgucggaggagccuuaaauucuuuaggaaaaggaauucaucaaauauuuggggccgcauucaaaagucuauuugguggaaugucaugguuuucacaaauauuaauaggaacauuguuaauguggcuaggauuaaacacuaaaaacggaagcauaucacuaaugugucuagcuuuggguggaguacuaauauuucuauccacugcuguaucagcagacgugggguguagcguggacuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6882 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugagaauaaucaaugcgaggaaagaaaagaaaagaagaggagccgacacuagcgucgguauaguagguuuauuauuaacaacugccauggccgccgaaguuacaagaagagguucagcauacuacauguauuuagauagaaaugaugcaggagaagcuauuuccuuuccuacaacucuuggaaugaauaaauguuauauccaaauuauggaucuaggacauacgugcgaugcaacaaugagcuacgaauguccaauguuagaugaaggaguagaaccagaugacguugauugcugguguaacacaacuucaacauggguaguuuauggcacaugucaucauaagaaaggagaagcaagaagaaguagacgugcaguaacauuaccaagucauucaacuagaaaacuacaaacuaggagccaaacauggcuugaaaguagagaguauacaaaacaccuuauuagaguagaaaauuggauauuuaggaauccaggauucgcguuagcagcagcugcaauagcaugguugcuaggaagcucaacaagucaaaaaguaauauauuuaguaaugauacuucuaauagcaccagcauauucaauaagauguaucggaguaucaaaccgagauuuugucgaaggaaugucuggugguacauggguagacguaguauuagagcacggaggauguguaacaguaauggcacaagauaaaccaacaguggauauagaauuggucacaacaaccguaucaaauauggcugaagucagaagcuacugcuaugaagcaucgauaagugauauggcgagugacucuagaugcccaacccaaggagaagcauacuuagauaaacaaucagacacacaauacguauguaaaagaacuuuaguagauagagguuggggcaacggauguggacucuuuggaaaaggaucgcuaguuacaugugcaaaauuugccuguucaaagaaaaugacgggaaaaucaauacagccagaaaauuuagaauauagaauaauguugaguguacauggaucccaacauucaggaaugauaguaaaugauacaggacaugaaacugacgaaaauagagcaaaaguugaaauaacaccaaauucaccacgugcagaggcgacacucggugguuucgggucauugggucuugauugugaaccaagaacaggauuagauuuuucagauuuauauuacuuaacaaugaacaauaaacacugguuaguacauaaagaaugguuucaugauauaccguuaccauggcaugcaggagcagauacaggcacaccacauuggaauaauaaagaagcauuaguugaguucaaagaugcgcacgcuaaaagacaaacaguugucguauuagguagucaagaaggagcaguacauacagcgcuagcuggagcacuagaagcugaaauggauggagcaaaaggaagacuaaguaguggucauuuaaaauguagauuaaaaauggacaaacuuagguuaaaaggaguuaguuacucauuauguacugcggcuuuuacauuuacaaaaauaccugcagaaacauuacacgguacaguuacagucgaaguacaauaugcugguacagacggaccuuguaaaguaccagcucaaauggcaguagauaugcaaacacuaacaccaguuggacgccuaauaaccgcaaauccuguuauaacagaaucuacggaaaacucaaaaaugauguuagaauuagaucccccauuuggggauucauauauaguaauugggguaggagaaaagaaaauaacacaucacuggcacagaaguggaaguacaauaggaaaagcauucgaagcaacaguaagaggagcaaaaagaauggcaguccuaggggacacugcaugggauuucggaagcguaggaggggcuuuaaauagucucgggaaaggaauccaucaaaucuuuggagcagcguuuaaaucacuauuuggaggaaugucaugguuuucacaaauauuaauagguacuuuacuaaugugguuaggacuaaaugcuaaaaacggcucaauuucauuaauguguuuagcauuaggaggaguuuugauauucuuaucaacagcaguuagcgcugacguuggauguaguguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6883 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugcgaauaauaaacgcgagaaaagaacguaaacgucgaggagcagacacaagcauaggcauaauaggauuacugcuaacaaccgcaauggcagccgaaauaacaagaagaggaucagccuauuauauguaucuagauagaagugaugcagguaaagccauaucauuugcaaccacguuaggaguaaauaaaugccauguacaaauaauggaccuuggacauaugugcgaugcaacaaugucuuaugaauguccuaugcuagaugaaggaguagaaccagaugacguugauuguugguguaauacaacuuccacauggguagucuacggaacaugccaucacaaaaaaggugaagcuaggaggucaagacgagccguaacauuaccaucucauucaacaagaaaauuacaaacaagaucacaaacauggcuagaaucaagggaauauacaaaacaucuuauaaaaguagaaaauuggauuuucagaaauccugguuuugcacuaguagcaguagcaauagccuggcucuuagguagcaguaccagccaaaaaguaauauaucucgucaugauucuauuaauagcuccagccuacagcauaagauguauuggaguaucaaauagagauuuuguagaagguaugucuggaggaacauggguugauguaguuuuagaacaugggggauguguaacaguaauggcacaagauaaaccaacaguggacauugaauuagucaccacaacuguaucuaauauggcagagguacgaucauauuguuaugaagcaagcauaagcgauauggcgagugauucaagaugccccacacaaggagaagcuuauuuagauaaacaaagugauacacaguauguaugcaaaagaacccuaguggauagagguugggguaaugguugcggauuauuuggaaaaggaagucuaguaacaugugcaaaauucacuuguucaaaaaaaaugacagggaaaaguauacaaccagaaaauuuagaauauagaauaauguuaagcguacaugguucacaacauucgggaaugauaggauaugaaacagaugaagauagggccaaaguagaaguaacaccaaacaguccaagagcagaagccacacuuggugguuucggaucucucggauuagacugugaaccucgaacagggcuugacuuuucagaucuauacuauuuaacaaugaauaauaagcauuggcuaguucacaaagaaugguuucacgauauuccgcuuccauggcaugcgggagcagauacaggaacuccacauuggaauaauaaagaagcacuaguugaauucaaagaugcacaugcaaaaagacaaacagucguaguuuuaggaucacaagaaggagcaguacauacagcacuagccggagcuuuagaagcagaaauggauggugcaaaaggacgacuauuuagcggacaccuaaaaugucgucuaaaaauggauaaacuuagauuaaaaggaguaucguacucguuauguacagcagcauuuacauuuacuaaagugcccgcagaaacacuacauggaacagugacuguugaaguacaauaugcaggaacagauggcccauguaaaauuccuguucaaauggcaguugauaugcaaacauuaacuccaguuggaagacuaauaacagcaaacccuguuauaacagaaucaacugaaaauaguaaaaugauguuggaacuggacccaccauucggagauaguuacauaguaauagguguaggagauaagaaaauaacacaucauuggcacagaucagguaguaccauugguaaagcauucgaagcaacaguuagaggagcaaaaagaauggcaguucucggagauacagcaugggauuuugguagugugggagguguuuuuaacaguuuagguaaaggaauacaucaaaucuuuggugcagcuuuuaaaagccuauuuggaggaaugucaugguucucucaaauucuaauagguacacuauuaguuuggcuaggacuuaauacgaaaaaugggucuauuaguuuaacuuguuuagcacucggaggaguaaugauauucuuaaguacagcaguauccgcugacgucgguuguucaguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6884 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugagaauaauaaaugcaaggaaagaaaagaaaagaagaggagcagacacaagcguagguauaguaggguuauuauuaacaacugcuauggcugcugaaguaacaaggagggguagugcauauuauauguauuuagacagaaacgaugcaggggaagcaauaaguuuuccuacaacauuaggaaugaauaaauguuauauccaaauuauggacuuaggccauaugugugacgcuacaaugaguuacgaauguccaauguuagaugaagguguagaaccagacgauguggauuguugguguaacacaacaucaacauggguaguauaugguacaugucaucauaagaaaggagaagcaagaagaucaaggagagcuguaacucuaccuucacacagcacaagaaaauuacaaacuagaucacagaccugguuagaaucuagagaauauacaaaacauuuaaucagaguagaaaauuggaucuucagaaaccccggguuugcucucgcagcagcagcaauagcaugguuacuuggaaguucuacaucacaaaaaguuauuuaccuaguaaugauucuacuaauagcaccagcuuauagcauaagaugcauuggaguuaguaacagagacuuuguagaaggaaugucaggugguacuugggucgaugugguauuagaacaugggggaugcguaacuguuauggcacaagacaaaccaacaguagauaucgagcuaguaacaacaacgguaagcaacauggcagaagugagaaguuauuguuaugaagcaagcauaagugauauggcauccgauucacgauguccaacacaaggugaagcauaccuagauaaacaaucagauacacaauauguauguaaaagaacauuaguugauagggguuggggaaauggauguggacuauucggaaaagggucauuagugacgugugcaaaauuugccugcaguaagaaaaugacugggaaaagcauucaaccagaaaaucuagaauauagaauaaugcuaaguguacauggaucucaacauaguggcaugauaguaaacgauacaggacacgaaacugacgaaaacagagcuaaaguagaaaucacucccaauagcccaagagcugaagcaacacuaggaggauuuggaucauuaggacuugacugugaaccuagaacaggauuggacuuuagcgaucuauacuaucuaacaaugaauaauaaacauuggcuaguacauaaagaaugguuucaugauauuccacuuccauggcacgccggcgcagacacagggaccccucacuggaacaauaaagaagcauuaguagaguucaaagaugcucaugcaaaaagacaaacaguaguuguauuagguucgcaagaaggagccguacauacugcacuugcaggagcuuuagaagcagaaauggauggagcaaaaggacgauuaucuaguggacaucuaaaauguagacuaaaaauggacaaauuaagauuaaaaggaguaagcuauucauuauguacagcagcauuuacauucacaaaaauaccugcugaaacccuacacggcacaguaacaguagaaguucaauaugcaggaacugauggaccuugcaaaguacccgcacaaauggcaguugauaugcaaaccuuaaccccuguuggcagacuaaucacagcaaacccaguuauaacagaaucaacagaaaauagcaaaaugaugcuagaacuggauccaccuuucggugauucauauauaguaauaggaguaggggaaaagaaaauuacucaucacuggcauagaucaggaucaacaaucgguaaagcauucgaagcuacaguacgaggggcaaaaagaauggcaguacuaggagauacugcaugggauuuugguaguguagguggagcacuaaauuccuugggaaaaggaauacaccaaauauuuggagcugcauuuaaaagucuauuuggaggaaugagcugguuuagccagauucuaauuggaacauuacuuauguggcucggauuaaacacaaagaauggaaguauuucauuaauguguuuagcucucgguggcguauuaauauuuuuaaguacagcaguuagcgcagacguuggauguucaguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6885 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugacaagcguaggaauuguuggacuauugcuaacaacugcaauggcugcagagguaacucgaagaggcagcgcauacuacauguauuuggauagaaaugacgcaggggaagcaauaagcuuuccaacgacauuaggaaugaauaaauguuauauacaaauaauggauuuaggacacaugugugaugcaacuaugaguuaugagugcccaaugcuugaugaaggagucgaaccagaugauguugauuguugguguaauaccacaaguacauggguugucuacggaacaugucaccauaaaaaaggugaagcuagaagaaguagaagagcaguaacacuacccagucacucaacuagaaaacuacaaaccagaucccaaacaugguuagaaaguagggaauacacaaaacaucuaauuagaguugaaaacuggauauuuagaaauccagguuucgcuuuagcagcagcagcaauugcuugguuauuaggaaguucaacaucacagaaaguuauauaccuaguaaugauacuacuaauugcacccgcauauaguauacgauguauuggaguuagcaaucgugauuucguugaaggaaugucaggaggaacuuggguugacauaguauuagaacauggaggguguguaacgguuauggcacaagauaaaccaacgguugauauagagcuaguaacaacaacaguuagcaauauggcagaaguacgaucauauugcuaugaagcuucaauaucagauauggcaucagauucgagauguccaacacaaggggaagcauauuuagauaaacaaagugauacacaauauguauguaaacgaacacuaguagauagagguugggggaauggaugugguuuauucggaaaaggaucacuuguaacaugugcaaaguuugcauguucaaaaaaaaugacaggcaaaagcauacaaccagaaaaucuagaauacagaaucauguuaucaguacauggaucucaacauagcggaaugauaguuaaugacacaggacaugaaacagaugaaaauagagcgaaaguagagauaacaccuaauaguccaagagcagaagcaacauugggaggauucggaucucuaggacuagauugugaaccacgaacaggacuugacuuuucugauuuauacuaucuaacaaugaacaauaaacacuggcuaguacauaaagaaugguuucacgauauaccacuaccauggcacgccggagcagauaccggaacaccacauuggaauaauaaagaagcauuaguagaauuuaaagaugcccaugcuaaaagacaaacaguuguagugcuuggaagucaagaaggagcaguacauacagcauuggcuggugcauuagaagcagaaauggauggugcaaaaggaaggcuaaguucuggacaucuaaaauguaggcuaaaaauggauaaauuaagauuaaaaggaguaucauauucauuauguaccgcugccuucacuuuuacaaaaauaccagcagaaacgcugcacggaacuguaacaguugaaguacaauaugcuggaacagauggaccaugcaaaguuccugcacaaauggcuguagacaugcaaacacugacuccuguugggagacuaauuacagcaaaccccguaauaacagaaaguaccgaaaacucuaaaaugauguuagaauuagauccaccuuucggggauaguuauauaguaauaggaguaggggaaaaaaaaauaacucaucacuggcauaggagcggcaguacuauagguaaagccuuugaagcaacugucagaggugcaaaaagaauggcaguguuaggugacacagcaugggauuucggaucaguaggaggugcauuaaauaguuuaggcaaaggcauucaucaaauauuuggggccgcauucaaaagucuguucggaggaaugagcugguucagucagauauuaauaggaacacuauuaauguggcuaggucuaaacacaaaaaacgggaguauuagucucaugugucuugcauuaggaggaguauuaauauuuuuaaguacagcagucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6886 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccucaguagguauaguagguuuacuauuaacaaccgcaauggcagcagaagugacaagaagaggaucagcauacuauauguauuuagauagaaaugaugcaggagaggcaauuucauucccaacaaccuuaggaaugaacaaauguuauauacaaauaauggauuuaggacauacaugugacgcaacaaugaguuacgaauguccaaugcuagacgaagguguagaaccagaugacguagacugcugguguaauacaacaucaacauggguuguuuacggaaccugucaucauaagaaaggugaagcaagaagaaguagacgagccguaacucuaccaucacacucaaccagaaaacuccaaacaagaagucagacauggcuugaaagccgagaauacacuaaacauuuaauaagaguugaaaauuggauuuuuagaaacccaggauucgcauuagcagcagcagcaauagcgugguuacuagguucaucaacgucacaaaaaguuauuuauuuagucaugauucuguuaauagcaccagcuuacaguauaagauguaucggaguaucaaauagggacuuuguugaaggaauguccggagguacuuggguagauguaguauuagaacauggaggauguguaacaguaauggcacaagacaaaccaaccguagauauagagcuaguaacuacuacaguauccaauauggcagaaguacguaguuauuguuaugaagccagcauaagugauauggcaucagauucaagaugcccaacacaaggugaagcauauuuagauaaacaaagugacacacaauacguauguaaaagaacauuaguagacagaggauggggaaaugguuguggauuauucgggaagggaucacuuguaacuugugccaaauucgcaugcucaaagaaaaugacagggaaaucgauacaaccagaaaauuuagaauacagaauaaugcucaguguacauggaagccaacauucaggaaugaucguuaaugauacuggucaugaaacagacgaaaacagagccaaaguugaaauaacaccuaauucaccaagagcugaagcaacauuaggaggauucggaucauuaggucuagacugugaaccaagaacaggucuagacuuuagcgauuuauauuaccuaacuaugaauaauaaacauuggcuaguucauaaagaaugguuucaugauauaccacucccuuggcaugcaggagcagacacaggaacaccacauuggaauaauaaagaagccuuaguagaauuuaaagaugcacaugcuaaaagacagacaguuguuguacucggaucucaagaaggagcaguacauacagcauuagcaggagcauuagaagcagaaauggauggugcaaaagguagauuaucuaguggucaccuuaaaugucgauuaaaaauggauaaauuaagauuaaaagggguuucauauagucuuugcacugcugcguuuacauuuacuaaaauaccagcagaaacucuacacggcacaguaacuguagaaguacaauaugcuggaacugacggccccuguaaaguaccagcgcaaauggcugucgauaugcaaacccuaacacccguaggaaggcugauaacagcaaauccuguaauaacagaaaguacggaaaauucaaaaaugauguuagaacuagauccaccauucggcgauucauacauaguaauuggaguaggagaaaagaaaauaacccaccauuggcauaggagcggaagcacaauaggaaaagcauucgaagcaacaguaagaggugcaaaaagaauggcaguacuaggagauacagcuugggacuuuggauccguugguggagcauuaaauucguuagguaaaggaauacaccaaauuuucggagcagcuuucaaaucccuauuuggaggaaugucaugguuuucccaaaucuuaauaggaacacuauuaauguggcuaggccuaaaugcuaaaaauggaucuauaucauuaaugugcuuagcacuaggcggcguucugauauuuuuaagcacugcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6887 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugacaaguauaggaaucauuggauuacuacuaacaacugcaauggcagcagaaauaacuagacgaggaucagcauauuacauguauuuagauagauccgaugcuggcaaagcaauuucauuugcaacaacacuaggaguaaacaaaugucauguucaaauaauggaucuaggacauaugugugaugccacaaugucguaugaguguccaauguuagaugaagguguagaaccagacgauguagauugcugguguaauacgacauccacauggguaguauauggaacuugucaucacaagaaaggagaggcaagacgcuccaggagagcaguuacauuaccaagucauaguacaagaaaauuacaaacaagaagccaaacuuggcuugaaucgagagaauauacaaaacauuuaauuaaaguagaaaauuggauauuuagaaacccaggauucgcauuaguggcagucgcaauugccuggcuauuagggagcaguacaucacaaaaaguaauauaucucguaaugauacuauuaauagcuccugcauacagcauaagaugcauaggaguuucaaaccgagauuuuguagaagguaugagcggaggcacauggguagacguuguacuagaacauggaggaugugucacugugauggcacaagacaaaccaacaguagauaucgaacugguaacaacaacaguaaguaauauggcagaaguaagauccuauugcuaugaagcaucgauaucagacauggcaagugauucuagaugcccaacucaaggagaagcauauuuagauaaacaaagcgacacacaauauguaugcaagaggacucuaguagauagagguugggguaauggauguggcuuauuuggaaaaggaagucucguaacaugcgcaaaguucacauguucaaagaaaaugacuggaaaaucuauacaaccagaaaauuuagaguauagaauaaugcucagcguacaugguucacaacacaguggaaugaucggauacgaaacugacgaagaccgagcaaaaguugaaguaaccccuaauucaccaagagcagaagcaacauuaggaggguucggaagccucggauuagacugcgaaccacgaacaggauuagauuuuucagaucuauacuauuuaacaaugaacaacaaacauugguuaguucauaaagaaugguuucaugauauaccacuaccauggcaugcaggcgcugauacaggcacuccacauuggaauaacaaagaagcauuaguagaauuuaaagacgcacacgcaaaacgacaaacaguaguaguuuuaggaagccaagaaggagcgguacacacugcauuagccggugcauuagaagcagaaauggauggugcaaaaggaagacuauuuucuggucauuuaaaaugucgauuaaaaauggauaaauuaagacucaaaggaguaucuuacaguuuauguacagcagcauucacauucacaaaaguaccugcagaaacauuacauggaacgguuacaguagaagugcaauaugcuggaacagauggaccauguaaaauaccagugcaaauggcuguagauaugcagacuuuaacaccagucggaagauuaauaaccgcaaauccaguaauaacagaaaguaccgaaaauucaaaaaugauguuagaauuagauccaccauuuggcgacaguuauauuguuauaggaguaggcgauaagaaaauaacacaucacuggcauagaagcggaucuacaauaggaaaagccuuugaagcaacaguaagaggagccaaaagaauggcaguacucggugauacagcuugggauuucggaucuguuggaggaguuuucaauucauuaggcaaaggaauacaucaaauauucggagcugccuuuaaaucauuauuugguggaaugucaugguuuucucaaauucuaauagguacauuacuuguauggcuaggacuaaacacuaaaaaugguucaauaucacuaacaugucuagcuuuaggcggaguaaugaucuucuuaagcacagcuguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6888 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugacaucaguaggaauagucggacuuuuguuaacgacagccauggcagcugaaguaacaagaagaggcucugcauacuauauguaucuagaccggaacgacgccggagaagcaauaucauucccaacaacauuaggcaugaauaaaugcuacauacaaauuauggaucuuggacauaugugcgaugcaacaaugucuuaugaauguccaauguuggaugaaggaguugaaccugacgauguagacugcuggugcaacacaacaucaacauggguuguauaugguaccugucaucauaaaaaaggcgaagccagaagaucaagaagggcaguaacacugccuagucauaguacuagaaaauuacaaacuagaucacaaacuugguuagaaucaagggaauacacaaaacaccuaauacgaguagaaaauuggauauuucgaaauccaggguucgcacuagcagcagcugcaauagcauggcuuuuaggaaguucaacaagccaaaaagucauauaucuaguuaugauucuacuuauagcaccugcauacucaauacgaugcauaggagucucaaauagggauuuuguagaagguaugucaggagggaccuggguagacguaguacuagaacaugguggauguguaacagucauggcacaagauaaaccaacaguagacauagaauuaguaacaacgacugucuccaauauggccgaaguuagaucauacugcuacgaagcuucuauaucagauauggcaagcgauucaagaugucccacccaaggugaagcauaucuagacaaacaaucagauacacaauacguuuguaaaagaacauuaguagacagagguuggggaaauggauguggauuauuuggaaaagguaguuuaguaacaugcgcaaaauuugcuugcagcaaaaaaaugacaggaaaauccauacaaccagaaaaccuugaguauagaauaaugcucaguguucauggaucacaacauucuggaaugauaguaaaugacacaggacacgaaacugacgagaaucgugcuaaaguagaaauaaccccaaauaguccuagagcagaagcaacauuaggcggauuuggaaguuuaggauuagauugugaaccaagaacaggcuuggauuuuagugaucuauauuacuuaacaaugaauaacaaacauugguugguccauaaagaaugguuccaugauauaccauuaccauggcacgcuggagcagauacuggaacaccgcauuggaauaauaaagaagcacuuguugaauucaaagacgcucaugcuaaacgacaaacaguaguuguacucggaagccaagaaggcgcaguccacacagcucuagcaggagcguuagaagcugaaauggauggcgcaaagggaagauuaagcucaggacaccuaaaaugcagacuuaaaauggacaaacuaagauuaaaaggaguuaguuauagccuauguacagcagcauucacauuuacuaaaauaccagcugaaacauuacauggaacuguuacaguagaaguacaauaugcaggaacagaugguccauguaaaguaccugcacaaauggcaguagauaugcaaacauuaacaccugucggaagauuaauuacagcaaauccuguaauaacggaaaguaccgaaaauucaaaaaugaugcuagaauuagacccaccuuuuggcgauagcuacauaguaauuggaguaggagaaaaaaaaauaacacaucauuggcaccgaaguggaagcacaauaggaaaagcauuugaagcaacaguuagaggagcaaaaagaauggcaguauuaggggauaccgccugggauuucgguucuguaggaggugcacuaaauagucuuggaaaaggcauacaccaaauuuuuggagcagcuuucaaaucacuguuugguggaaugaguugguuuucacaaauucuaauaggaacauuauuaaugugguuaggauuaaauacaaaaaacggaucaauaagcuuaaugugucuagccuuaggaggcguauuaauauuccuaucgacagccguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6889 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugagucaaaaaguaauauaucuagucaugauauuauuaauagcaccagcauauucaauaagauguauaggagucucaaacagggauuucguagaaggaaugaguggagguacguggguagauauaguuuuagaacauggaggauguguaaccguuauggcacaagacaaaccaacaguagacauagaguuagucacaacaacaguaagcaauauggcagaaguaagaucauacuguuaugaagcaaguauaagugauauggcaagugacucaagauguccaacucagggagaagcauaccuagacaaacaaucagacacacaauacguauguaaacgaacacuaguggauagaggauggggaaaugguuguggacuauuuggaaaaggaagccugguuacaugcgcuaaauuugccugcucaaaaaaaaugacaggaaaaucaauacaaccagaaaaucuagaauaucggauuauguuaagcguacauggaagccaacacucaggaaugauaguaaaugauacaggacaugaaacagaugaaaaucgagcaaaaguggaaauaaccccaaacagcccaagagcagaagcuacacuaggaggauuuggauccuuaggacuagauugugaacccagaacaggacuagacuuuucugauuuauacuaucuuacaaugaauaauaaacauugguuaguacacaaagaaugguuccaugauauaccauuaccauggcaugcaggagcagauacgggcacaccacacuggaauaauaaagaagcauuaguagaauuuaaagaugcacacgcaaaaagacaaacaguaguaguauuaggaucacaagaaggcgcaguucauacagcccuagcaggagcacuagaagcagaaauggauggagcaaaaggaaggcuuagcagcggucauuuaaaaugcagauuaaaaauggauaaauuaagacuaaaaggaguaaguuauagucuauguacagccgcauuuacauuuacaaaaauaccagccgaaacuuuacauggaacaguaacaguagagguacaauaugcaggaacggacggaccauguaaaguaccagcacaaauggcuguagacaugcaaacacuaaccccaguaggcagauuaauaacagcuaauccaguuauaacagaaaguacagaaaauucuaaaaugaugcuagaauuagacccaccuuuuggagacucauauauaguaauagguguaggagaaaaaaaaauaacacaucauuggcauagaucaggaaguacaauaggaaaagcauucgaagcaaccguaagaggagccaaaagaauggcgguacuaggugauacagcaugggauuuuggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6890 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugagucaaaaaguuauauauuuaguuaugauuuuacuuauagcuccggcauacaguauaagauguauaggaguaucaaauagagauuucguagagggaaugaguggaggaacauggguagauguaguauuagaacauggagguuguguaacaguaauggcacaagacaaaccaacaguagauauagaauuaguuacaaccacaguaucaaauauggcagaaguaagaagcuauugcuaugaagcaaguauaagugacauggcaagugauagcagauguccaacacaaggagaagcauauuuagauaaacaaagugauacacaauacguuuguaaaagaacauuaguagauagagguuggggaaacggaugugguuuauuuggaaaagggucuuuaguaacuugugcgaaauuugcuugcaguaaaaaaaugacaggaaaaucaauacaaccagaaaauuuagaauauaggauaauguuaucaguacauggaucucaacauagcgguaugauaguaaaugacacaggacaugaaacagaugaaaauagagcaaaaguagaaauaacaccgaauucgcccagagcagaagcaacacugggaggauuuggaagccuaggacuagauugugaaccaagaacgggacuagauuuuucagaucuguauuaucuuacaaugaauaauaaacauuggcuagugcauaaagagugguuucaugauauaccacuaccauggcaugcaggagcagacacagguacaccacauuggaauaauaaagaagcacuaguagaauucaaagacgcacaugcaaaaagacaaacaguuguuguacuaggaagccaagaaggagcaguacauacagcauuagcaggggcauuagaagcagaaauggacggagcaaaagguagacuaucgagcggacaccuaaaauguagauuaaaaauggauaaacuacgauuaaaaggaguaaguuacaguuuaugcacagcugcauuuacauuuacaaaaauaccggcagaaacauuacauggaacgguuacaguagaaguacaauacgcuggaacagauggacccuguaaagugccugcgcaaauggcaguggacaugcaaacauugacaccaguaggaagacuaauaacagcaaauccaguaauaacagaaaguacggaaaauaguaaaaugauguuagaacuagauccuccauuuggagacucauauauaguaauaggaguaggagaaaaaaaaaucacacaccacuggcacagaucaggaucgacaauaggaaaagccuuugaagcaacaguaagaggagcaaaaagaauggcuguauuaggggacacagcaugggacuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6891 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugucacaaaaaguaauuuaucuaguuaugauauuauuaauagcuccagcauacaguauaagauguauaggaguaucaaacagagacuuuguagaaggaaugucaggaggaacauggguugacguaguauuagaacacgguggaugcguaacaguaauggcacaggacaaaccaacaguugauauagaauuaguuacaacaacaguuucaaauauggcugaaguaagaucauauuguuaugaagcaaguauaagugacauggccagcgacaguagaugcccuacacaaggagaagcauaccuagauaaacaaagcgauacacaauacgucugcaaaagaacccuaguagacagagguuggggcaacgguuguggacuauuugguaaagguagcuugguaacaugugcaaaauuuacauguucaaagaaaaugacaggaaaaucaauacaacccgaaaaucuugaauauagaauaaugcugaguguacauggaagucaacauucaggaaugaucggauacgaaacagacgaagauagagcaaaaguagaaguaacaccaaauucaccgagagcagaagcaacacuaggaggauuuggcucacuaggauuagacugugaaccaagaacaggacuagauuucagugaucuauacuaccuaacaaugaacaacaaacacugguuaguacauaaagaaugguuucaugacauaccauuaccuuggcacgcaggagcagauacaggaacaccacauuggaauaauaaagaagcauuaguggaauuuaaagaugcucaugcaaaaagacaaacaguaguaguacuaggaagucaagaaggcgccguacacacagcucuagcaggagcauuagaagcagaaauggauggagcaaaaggaagauuauuuaguggacacuuaaaauguagauuaaaaauggauaaacuaagauuaaaagguguaucauauaguuuauguacagcagcuuucacauuuacaaaaguaccagcagaaacauuacauggaacagucacaguagaaguacaauacgcaggaacagauggaccauguaaaauaccaguacaaauggcaguagacaugcaaacacuaacuccaguaggaagguuaauaacagcaaauccaguaauaacagaaaguacagaaaauaguaaaaugauguuagaauuagaucccccauuuggagacaguuauauagugauaggcguaggagacaagaaaauaacacaucauuggcauagaucagguucaacuauaggaaaagcauuugaagcuacaguaagaggugcgaaaagaauggcaguacuaggagauacagcaugggacuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6892 - RNA, 1741 nt, Artificial Sequence
  ZIKV (strain NatalRGN) Polyprotein(273-723) mRNA Design 2 opt
ggggcgcugccuacggagguggcagccaucuccuucucggcaucaagcuuaccaugagucaaaaaguuauauauuugguaaugauauuacuaauugcuccagcauauucaauacgaugcauaggaguaucaaauagagauuucgucgaaggaaugaguggaggaacauggguagauguaguauuagaacauggaggaugcguaacaguaauggcacaagauaaaccaacaguagauauagaacuaguaacaacaaccguaucaaacauggcagaaguaagaucauauuguuaugaagcaucaauaagcgacauggcgucugauaguagaugcccaacacaaggugaggcauauuuagauaaacaaagcgauacacaauauguuugcaaaagaacauuagucgauagaggauggggaaauggauguggauuguucggaaaaggaucacuagucacaugugcaaaguuugcauguaguaaaaaaaugacaggaaaaaguauccaaccagaaaacuuagaauauagaauaaugcucaguguacaugguagucaacauaguggcaugauagugaaugauacaggucaugaaacagaugaaaaucgagcgaaaguagaaauuacacccaauucuccuagagcagaagcaacuuuaggaggauuuggaaguuuaggauuagauugcgaaccaagaacaggauuagacuucagcgaucuauacuauuuaacaaugaacaauaaacauuggcucguacauaaagaaugguuucaugacauaccucuaccuuggcacgcaggagcagauacaggaacuccacauuggaauaauaaagaagccuuaguagaauuuaaagaugcacaugcaaaaagacaaacaguagucguacuaggaagccaagaaggagcaguacauacugcauuggcaggagcauuagaagcagaaauggacggugcaaaaggaagguuaucaaguggacaucuaaaaugcagacuuaaaauggauaaauuaagauuaaaaggaguaaguuauucauuaugcacagcagcauuuacauuuacaaaaaucccagcagaaacacuacauggaacaguaacaguagaaguacaauacgcaggaacugauggaccauguaaaguaccagcacaaauggccguugauaugcaaacauuaacaccaguaggaagauuaauaacagcaaauccaguaauaacagaaaguaccgaaaacaguaaaaugauguuagaacuagauccuccauuuggagacaguuacauaguuauaggaguaggagaaaaaaaaauaacacaccauuggcacagaaguggaagcacaauagguaaagcauuugaagcaacaguaaggggagcaaaaagaauggcaguacuaggagauacagcaugggauuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6893 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugacaucaguaggaauuguuggauuauuacuaacaacagcaauggcagcagaaguaacaagacgaggaagcgcauauuauauguaucuggauagaaaugaugcuggugaagcaauaaguuuuccaacaaccuuagguaugaauaaauguuacauucaaaucauggauuuaggacacaugugugaugcaacaaugucauaugaauguccuaugcuagaugaaggcguugaaccagacgauguggauuguuggugcaacacaacaaguacaugggugguauaugguacgugucaucacaagaaaggagaagcaagaagaucaaggagagcaguuacacuuccaagccauaguacaagaaaauuacaaacaagaagucaaacaugguuagaaucaagagaguacacaaaacaccuaauuagaguagaaaauuggauauucagaaauccaggguucgcacucgcagcagcagcuauagcaugguuacuaggaaguaguacaagucaaaaaguaauauaucuaguaaugauacuauugaucgcgccagcauauucuauaagauguauaggaguaagcaauagagauuuuguagaagguaugucuggagguacauggguagauauaguauuagaacacggcggaugcgucacaguaauggcccaagauaaaccaacaguagauauagaacucguaacaacaacaguuaguaauauggcagaaguaagaagcuacuguuacgaagccaguauaucagacauggcaagugauucaagauguccaacacagggagaagcauauuuagauaaacaaucugacacacaauauguuugcaaaagaaccuuaguagacagaggauggggaaacggaugcggacuaagcggaaaagguagcuuaguaacaugugcaaaauucgcaugcucaaagaaaaugacuggaaaaagcauacaaccagaaaacuuagaauauagaauuauguuaaguguacauggaucacaacacaguggaaugauaguaaacgacacuggacaugaaaccgaugaaaaucgagcaaaaguagaaauaacaccuaauagcccgagagcggaagccacacuaggaggauucggaaguuuaggacuagacugugaaccaagaacaggauuagacuuuagugaucuauauuauuuaaccaugaacaauaaacauugguuaguucauaaagaaugguuccaugacauaccauuaccauggcacgcaggagcagauaccgguacgccgcauuggaauaacaaagaagcucuaguagaauuuaaagaugcacaugcaaaacgacaaacuguagugguacuaggaucacaagaaggagcaguucauacagcuuuagcgggggcgcucgaagcagagauggacggugcaaaagguagauuaaguucaggacaccuaaaauguagacuaaaaauggauaaacuaagauuaaaaggaguaucguauucuuuauguacagcugcguuuaccuuuacaaaaauuccagcagaaacauuacauggaaccgucacaguugaagugcaauacgcaggaacugaugguccaugcaaagucccugcacagauggcaguagauaugcaaacgcuaacaccgguaggacgauugaucacugcgaauccugugauaacugaaagcaccgaaaauucaaaaaugaugcuggaauuagauccuccauuuggagacaguuacauaguaauaggaguaggagaaaagaaaauaacacaucauuggcacagaucaggaaguacaauaggcaaagcauuugaagcuacagugaggggagcaaaacgaauggcaguauuaggugauacagcaugggacuuuggcaguguaggaggggcacuaaauucuuugggaaaagguauacaucaaaucuuuggagcagcauuuaaaaguuuauuuggaggaaugagcugguuuucacaaauuuugauaggcacuuuauuaaugugguuaggacuaaauacuaaaaauggaucaauaucauuaauguguuuagcuuuaggaggcguauuaauauuuuuauccacagcagugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6894 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugacauccguaggaauuguaggauuauuacuaacaaccgcaauggcagcagaaguaacgcgacgaggaagugcauauuacauguacuuagauagaaaugacgcuggugaagcaauaaguuuuccuacaacucuugggaugaacaaauguuacauccaaauaauggaucuuggccauacaugugaugcaacaaugucauaugaauguccaauguuagaugaaggagucgaacccgacgaugucgauuguuggugcaauaccacaucaacauggguuguauauggaacaugccaucauaagaaaggagaagcgcggagaaguagacgagcaguaacauuaccaucacauucgacacgaaaauuacaaacaagaagucaaacaugguuagaaagcagagaauacacaaaacauuuaauaagaguagaaaacuggauauuuagaaauccaggguuugcauuagcagcagcagcaauagcauggcuucuaggauccaguaccucacaaaaaguaauauacuuaguaaugauauuauugauugcaccagcuuauucuauaagauguauuggaguuagcaauagagauuuuguagaagggaugaguggaggaacauggguagauguaguuuuagaacacggagguuguguaacaguaauggcacaagauaaaccaacaguagauauagagcuaguaacaacuacugugagcaauauggcagaaguucgaucauacuguuacgaagcaucaauaagugacauggcaucggauagcagauguccaacacaaggugaagcauaucuagauaaacaaucagauacucaauauguauguaaacgaacuuuaguagauagaggauggggaaauggaugcgguuuaagcggaaaaggcucauuaguuacaugugcuaaauucgcuuguaguaagaaaaugacaggaaaaucaauacaacccgaaaaucuagaauaucgaauaauguuauccguacauggaagccaacauucagguaugauaguaaaugacacaggacaugaaacagacgaaaauagagcuaaaguagaaauaacuccuaauucaccaagagcagaagcuacacuaggagguuucgguagccuaggguuagauugugaaccaagaacaggauuagacuuuucagacuuauauuaccuaacaaugaauaauaaacauugguuaguucacaaagaaugguuucacgauauaccauugccuuggcaugcaggagcagauacuggaacaccacacuggaauaauaaagaagcauuaguagaauuuaaagaugcacacgcaaaaagacagacaguugucguauuagggucacaagaaggagcuguacauacagcauuagccggagccuuagaagcagaaauggacggagcaaaaggaagacuaaguagcggacaucuuaaauguagacuaaaaauggacaaacuacgacugaaaggaguaucauauucauuauguacagcagcuuuuacauucacaaaaauaccagcugaaacccuacauggaacaguaacagucgaaguucaauacgcaggaacggacggaccauguaaaguaccagcucaaauggcaguagacaugcagacuuuaacaccaguagggaggcuaauuacagcaaacccuguuauaacagaaucaacggaaaacucaaaaaugauguuggaauuagauccaccuuuuggagacucauacauaguaauaggaguaggagaaaagaaaauaacacaucacuggcaucgaaguggaucaacuauugguaaagcauuugaagcaaccguaagaggagcuaaaagaauggcuguuuuaggugauacagcgugggauuuuggcucagugggaggugcauuaaacucuuuaggcaaagggauacaccaaauauuuggugccgcauuuaaaucauuauucggaggcaugucaugguucagccaaauauuaauaggaacauuauuaaugugguuaggucuaaacgcaaagaacggaaguauuucucuaauguguuuagcauuaggaggaguucuaauauuucuaucaaccgcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6895 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugacaucaauuggaauaaucggcuuauugcuaacuacagcaauggcagcugaaauuacaagaagaggaucagcuuauuauauguaucuagacagaucagaugcugguaaagcaauuucauucgcaacaacacuaggcguaaauaaaugucacguacaaauaauggauuuaggccauaugugcgaugcaacaaugucguaugaauguccaauguuagacgaaggaguggaacccgaugauguagacuguuggugcaacacaacuucaacauggguaguauacggaacaugccaucacaaaaaaggagaagcaagaagaucaagacgagcaguuacucuaccaagccauaguacaaggaaacuacaaaccagaucacaaacauggcuagaaucacgugaauacacaaagcauuuaauaaaaguagaaaacuggauauuuagaaauccaggguucgcauuaguggcaguagcaauagcauggcuauuaggaucaucaacaucacaaaaaguaauauauuuaguaaugauauuauuaauagcgccagcauauaguauacgauguauaggaguaucaaacagagauuuuguggaaggaaugucaggagguacauggguggacguaguucuagaacacggaggcuguguaacaguaauggcacaagacaaaccuaccguagauauagaacuagugaccacaacaguaucaaacauggcggaaguaaggucuuauugcuaugaagccaguauaucagauauggcaucugauagcagaugcccaacacaaggagaagcauaucuugauaaacaaucugauacacaauauguauguaaaagaaccuuaguagaucgaggauggggaaaugguuguggacuaucagguaaagguucauuagucacaugugcuaaauucacuuguaguaaaaaaaugacaggaaaaucuauacaaccagaaaaucuugaauauaggauaauguuaaguguccacggaagucaacauucagggaugauagguuaugaaacagaugaagacagggcaaaaguagaaguaacaccaaacagcccaagagcggaagcaacauuaggaggauucggaagccucggacuagacugugaaccacggacgggauuagacuucagcgaucuuuauuauuuaacaaugaauaauaaacacuggcuaguucauaaagaaugguuccaugauaucccucuaccauggcaugcaggagcagauacaggaacaccccacuggaauaauaaagaagccuuaguagaauuuaaagaugcccacgccaaaagacaaacgguaguuguauuaggaucacaagaaggagcaguacauacggcguuagcuggcgcccuagaagcagaaauggauggugcgaaaggaagacuauuuucaggccaucucaaaugcagauugaaaauggauaaacuuagacuaaaaggaguaucauauucauuauguacagcagcauuuacauuuaccaaaguaccagcagaaacauuacauggaacaguuacaguagaaguucaauaugcagguacagauggaccuuguaagauaccaguacaaauggcgguagauaugcaaacacucacuccaguugguagauuaauuacugcaaacccaguaauaacagaaucgacggaaaauucuaaaaugauguuagaauuagacccaccauuuggagauaguuauauagugauaggugugggagauaaaaaaauaacacaucauuggcaucgaucagggucaacuauagguaaagcauucgaagcaacagugagaggggcaaaaaggauggcaguacuaggagauacugcaugggauuuuggcagugucggugggguuuuuaauagccuagguaaaggaauacaccaaauauuuggcgcagcguucaaaucauuauuuggcggaaugucaugguuuucucaaauacuuauaggaaccuuacuaguaugguuggguuuaaacaccaaaaauggaaguauuucacuaacauguuuagcccugggaggaguaaugauauuucuaagcacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6896 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugacaucaguaggaauaguaggacuacuauuaacaacagcaauggcagcugagguaacaagaagaggaagcgcuuauuauauguauuuagauagaaaugaugcaggagaagcuaucagcuucccaacaacacuaggaaugaacaaauguuauauacaaauaauggauuuaggccacaugugcgaugcaacaaugagcuaugaauguccaauguuagaugaaggaguagaaccugaugauguugauuguuggugcaacaccacaaguacauggguaguuuauggaacaugccaucacaagaaaggugaagcacgaagaucaagacgagcaguaacacugccaucucauucaacacgaaaauuacagacaagaagucagacauggcuugaaaguagagaauauacgaaacaccuaauacgcguagaaaauuggauauuuagaaacccuggauuugccuuggcggcagcagcaauagcuugguuauuagguucuaguacaucacaaaaaguaauauaucuaguaaugauacuacuaauagcaccagcauacucaauaagaugcauaggaguaagcaacagagauuucguagaaggaaugaguggaggaaccuggguagauguaguccuagagcacggaggauguguaacaguaauggcacaagacaaaccaacuguagauauagaacuuguaacaacaacgguaucaaacauggcagaaguacgaaguuacugcuacgaagcaucaauaucugacauggcuucagauucaagaugcccaacacaaggagaagccuaucuagauaaacaaucagacacacaauacguuugcaaacgaacauuaguagaccgagguuggggaaacggaugugggcuaucagggaaagguucacuuguaacaugugcaaaauuugcaugcucaaagaaaaugaccgguaaaaguauucaaccagaaaaucuagaauacagaauuaugcuaucaguacacggaucacaacauagugguaugauaguaaaugacacuggacaugagacugaugaaaauagagcaaaaguagaaauaacaccaaauaguccaagagcagaagcaacauuaggaggauuugguaguuuaggacucgacugugaaccacggacugggcuggauuuuagugacuuauauuacuuaaccaugaauaauaaacacugguuaguacacaaagaaugguuccaugauauaccuuugccauggcaugcuggugcagauacaggaacuccccauuggaauaauaaagaagcacuuguagaauuuaaagaugcacacgcaaaacgacaaacaguaguuguacuagguucccaagaaggagcaguacauacagcacuugcaggagcucuagaagcugaaauggauggagcuaaaggacgauuaaguaguggacaccuaaaauguagacuuaaaauggacaaauuaagguuaaaaggaguaaguuauucauuauguacagcagcauucaccuucacuaaaauaccugcggaaacacuccacgguacaguaacuguagaaguacaauaugcaggaacagauggaccauguaaaguaccagcacaaauggcuguggauaugcaaacacuaacucccguaggaagacuaauaacugcaaacccaguaaucaccgagaguacagaaaacucuaaaaugauguuagaauuagauccaccauuuggagauucauacauuguaauuggaguaggugaaaagaaaauaacucaccauuggcauagaucuggaaguacaauaggaaaagccuucgaagcaacaguaagaggugcuaaacggauggcaguauuaggagauacggcaugggauuuugguucuguagguggagcacuaaacucccuagggaaagggauucaccaaauuuuuggagcagcauuuaaaucauuauuuggaggcaugagcugguuuucacagauacuaauagguacauuacuuaugugguuggguuuaaacacuaaaaacgguucaauuucauuaaugugcuuagcacuaggugguguguuaauauuucuaaguacagcgguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6897 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccagcguaggaauuguagggcucuuauuaacaacagcuauggcagcagaagugacaagaagggguagugccuauuacauguacuuagauagaaaugacgcaggugaagcaauuucauuuccaacaacauuaggaaugaauaaauguuacauacaaauaauggaccuaggacauaugugugacgcaacaaugaguuaugaaugucccauguuagacgaggggguugaaccagaugauguagauugcugguguaauacaacgaguacguggguaguauauggaacgugucaucauaaaaaaggagaagcucguagaaguaggagagcaguaacuuuaccaagucacucaacaagaaaauuacaaacaagaagccaaacaugguuagaaucaagagaauauacaaaacaucucauaagaguagaaaauuggauauuuagaaauccaggauuugcauuagcagcugcugcaauugccugguuacucggaaguuccaccucacaaaaaguaauauaccucguaaugaucuuguuaauagcaccagcuuauucgauaagauguaucggaguuaguaauagagauuuuguugaaggcaugagcggagggacauggguagauauaguacuugaacauggcggauguguuacaguaauggcacaagauaaaccaacgguagauauugaauuaguaacaacaacagucaguaacauggcugaaguaagaucauauugcuaugaagcuaguauaucugauauggcuagugauaguagauguccaacucaaggagaagccuauuuagauaaacaaagugacacucaauauguuuguaaaagaacauuaguagacagaggauggggaaaugguuguggauuauucggaaaaggaagcuugguaacaugugcaaaauucgcauguaguaaaaaaaugacaggaaaaucuauucaaccagaaaacuuagaauauaggauaauguuaucagugcacggcucacaacauaguggaaugauaguacaagacacagggcaugaaacagaugaaaauagagcaaaaguagaaauaacuccaaacaguccuagagcugaagcaacucuagguggauuuggaaguuuaggcuuagauugugaaccaaggacaggauuagauuuuagugauuuauauuaccuaacaaugaauaauaaacauuggcuuguacauaaagaaugguuccaugauauuccacuaccauggcaugcaggagcagacacugguacuccacauuggaauaacaaagaagcauuaguugaauuuaaagaugcccaugcuaaaagacaaacaguaguaguauuaggaagucaagaaggagcuguucacacugcacuugcaggagcacuagaagcagaaauggauggagcaaaaggacgguuaagcaguggacauuuaaaaugcagacuaaaaauggauaaacuucgauuaaaagggguaucauauaguuuauguacugcagcuuuuacguuuacaaaaauaccagcggaaacacuacauggaacaguuacaguugaaguacaguaugcaggcacugauggaccuuguaagguaccagcgcaaauggcaguagacaugcaaacacuaacuccagugggacgacuaauaacagcaaauccaguaauaacagaaagcacagaaaauaguaaaaugaugcuagaacuagacccaccauuuggagacucauacauagucauaggcguaggagaaaaaaaaauaacccaucauuggcacagaaguggaucaacuauaggaaaagcauuugaagcaacaguucguggagcaaagagaauggcaguauugggagacaccgcaugggauuucgguaguguuggaggugcacuuaauucauugggaaaaggaauacaucaaauuuuuggagcagcuuucaaaaguuuauucggcgggaugucaugguucagucaaauauuaauagguacuuuacuaaugugguuaggauuaaauacaaaaaaugguagcauuucacuuaugugucuagcauuaggagguguuuugauauuucuaucaacagcugugucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6898 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugacaucagucggaauagucggacuucuauuaacuacugcaauggcagcagaagucacaagaagaggaucagcuuauuacauguacuuagauaggaaugaugcuggagaagccauuagcuuucccaccacuuuaggcaugaauaaauguuacauacaaauaauggauuuaggacauacaugugaugcaacaaugucauacgaaugucccauguuagaugaagguguagaaccagaugauguugauuguuggugcaauacaacaucaacauggguaguauacggaacaugccaucauaagaaaggagaagcaaggcgaucaagacgagcaguuacauugccuagucauaguaccagaaaauuacaaacaagaucucaaacaugguuagaaaguagagaauacacaaaacaucuaauaagaguugaaaacuggauauucagaaauccaggauuugcacuagcagcagcagccauagcauggcuauuaggaucaagcacaagucaaaaaguuauauacuuagugaugauauuauuaauagcaccagcuuacucuauaagauguaucggagucuccaacagagauuuuguagaaggaaugucaggaggaacauggguugauguaguauuagaacaugguggauguguaacaguaauggcacaagauaaaccaaccguagauauagaauuagucacaacaacuguaucaaauauggccgaaguaagaaguuacuguuaugaagcaucaauuucugacauggcuucagauagccgcugccccacacaaggcgaggcauauuuagacaaacaaagcgauacacaauauguauguaaaagaacucuaguugauagaggaugggguaauggauguggacuauucgguaaagguucauuaguaacaugugcaaaauuugcuuguagcaagaaaaugacagggaaaucaauccaaccagaaaaucuagaauauagaauaauguuaucagugcacggaagucagcacucagguaugauaguucaagauacaggacaugaaacagacgaaaauagagcaaaaguggaaaucacgccaaauucaccaagagcugaagcuacccuagguggcuuuggaucauuaggcuuagauugcgaaccaaggacaggauuagauuuuucagaucucuacuauuuaacaaugaauaauaaacacuggcuaguccacaaagaaugguuccaugauaucccauugccuuggcaugcuggagcagauacagguacaccacauuggaauaacaaagaagcacucguagaguucaaagaugcacaugcaaaaagacaaacaguaguaguacuaggaucccaagaaggugcaguucacacugcacuggcaggagccuuagaagcagaaauggauggagcaaaaggaagauuaucaaguggacaccuaaaauguagauuaaaaauggauaaacuaagauuaaaaggaguauccuauucccucugcaccgcagccuucacuuuuacuaaaauaccagcagaaacauugcauggaacaguuaccguagaaguacaauacgcaggaacugauggacccuguaaaguacccgcacaaauggcaguagauaugcaaacacucacaccaguaggaagauuaauaacagcaaauccaguaauaaccgaaucaacagaaaacagcaaaaugaugcuugaauuagauccaccuuuuggagauucauauauaguaauugguguaggcgaaaagaaaaucacacaucauuggcauagaaguggaucaaccauaggaaaagcauuugaagcaacaguaagaggggcaaaacgaauggcgguccuaggagacacggcaugggauuuuggaucaguaggaggagcauuaaauucacuaggaaaaggcauucaucaaauauucggagcugcauucaaaaguuuauucggaggaaugucaugguuuagucaaauacuuauaggcacauuauuaauguggcuaggauuaaacgccaaaaaugggucaauaucacucauguguuuagcuuuagguggaguauuaauauuuuuauccacagcaguaucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6899 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugacaagcgugggaauaguuggacuacuauuaacaacagcaauggcagcagaagugacucgucggggaagugcauauuauauguauuuagauagaaaugacgcaggagaagcaauuaguuuuccaacaacauuaggaaugaauaaauguuacauacaaauuauggaucuaggacacaugugugaugcaacaaugucauaugaauguccgaugcuagacgaaggaguagagccagaugauguugacugcuggugcaauacaacaagcacauggguagucuacggaacuugccaucauaagaaaggagaggcacgaagaagccggagagcuguaacuuuaccuagccauucuacucgaaaauuacaaacaagaucacaaacuuggcuagaaagucgagaauauacaaaacauuuaauaagaguagaaaacuggauauuccguaauccuggguuugcucuugcagcagcagcaauagcguggcuacuaggaaguagcacaagucaaaaaguaauauacuuagugaugauauuauuaauagcuccagcauauucaauuagauguaucggugugaguaauagagauuucguagaaggaaugaguggagggacuuggguagauguaguuuuagaacacggaggaugugucacagugauggcucaagacaaaccaacuguagacauagaacuuguaacuaccacaguaucaaacauggcagaaguuagaaguuauuguuaugaagcaucuauaucagauauggcaucagauucacgauguccaacacaaggcgaagcguaucuagauaaacaaucggauacucaauauguauguaaaagaacuuuaguagauagaggauggggaaauggauguggccuauucggaaaaggaucauuagugacaugcgcuaaauuugccuguagcaagaaaaugaccgguaaaaguauucaaccagaaaauuuagaauauagaauaauguuaucaguucacggaucacaacauaguggaaugauaguucaagauacaggccacgaaacugacgaaaauagagcaaaaguagaaauaacaccaaauucuccaagagcagaagcaacacuaggcggauuuggaucauuaggauuggauugugaaccucgaacaggauuagacuuuagugauuuguauuauuuaacaaugaacaacaaacauugguuaguacacaaagaaugguuucacgauauaccacuaccauggcaugcaggagcagauacgggaacaccccauuggaauaauaaagaagcgcuuguagaauuuaaagaugcucaugcaaaaaggcaaacaguaguaguauuaggaagucaagaaggagcaguacauacagcucuagcuggagcccuggaagcugaaauggauggggcuaaaggaagacuuagcucaggacaucuaaagugccgauuaaagauggacaaauuaagauuaaaaggcguaaguuauucuuuauguacagcagcauuuacauuuacaaaaauaccagcagaaacgcugcaugguacuguaacaguagaaguacaauaugcaggaacugacggaccauguaaaguaccagcacaaauggcgguugauaugcaaacauuaacaccuguaggaagacucauuacagcaaacccaguuauaacagaaucuacagaaaauuccaagaugaugcuggaguuagaucccccauuuggugauaguuauauaguuaucgguguaggugagaagaaaauaacacaucacuggcaccgaaguggaucaacaauagguaaagcauucgaagcaacaguaagaggagcaaaaaggauggcaguauuaggugacacagccugggauuuuggaucuguaggaggagcacuuaauucauuaggaaaaggcauucaccaaauauuuggagcagcauuuaaaucauuauucgguggaaugucaugguuuucacaaauuuugauagguacacuacuaauguggcuaggacuaaacaccaaaaaugggucaauaagucuaaugugcuuagcguuaggaggaguacuaauauuccuaaguacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6900 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugacauccguagguauaguagguuuacuauuaacuacugcgauggccgcagaagucacaagaagagguucagcuuacuauauguaucuagaucguaaugacgcaggagaagcaauaucauucccuacaacauuagguaugaauaaauguuauauccaaauaauggauuuagggcauaugugugaugcaacaaugaguuaugaaugcccaaugcuagaugaaggaguagaaccagacgacguugacugcugguguaauacaacaagcacauggguaguauacggaacaugucaccauaaaaaaggagaagcucgaaggucacgacgagcgguuacauugccaucucauaguacaagaaaacuacagacaagaucacagacauggcuagaaaguagagaauacacaaaacaucuaauucgaguagaaaacuggauauuuagaaauccaggcuuugcacucgcagcagcugcaauagcauggcucuugggaaguucaacaucacagaaaguaauauaccuaguaaugauauuacuuauagcaccagccuauaguauuagguguauaggaguaucuaauagagauuuuguagaaggaaugagcggagggacauggguagauauaguacuagaacauggaggauguguaacuguaauggcacaagauaaaccaacaguugacauagaacuaguaacaacaacaguaucaaauauggcagaaguaagaaguuauuguuaugaagcgaguauaagugauauggcaucagauucaagaugcccuacacaaggagaagcauaccuagacaaacaaucggauacacaauauguauguaaaaggacauuaguugauagagguugggggaacggauguggguuauucggaaaaggaaguuuaguaaccugcgccaaauuugcauguaguaagaaaaugacagggaaaaguauccaaccugaaaaucuggaauacagaauuauguuaagugugcauggaagucaacacaguggaaugauaguaaaugauacgggacacgaaacagaugaaaauagggcaaaagucgaaauuacaccaaacagccccagagcagaagcaaccuuaggaggauuuggaucauuaggauuagauugcgaaccaagaaccggauuagacuuuagcgaucuguacuauuugacaaugaauaauaaacauuggcuaguacauaaagaaugguuccaugauauaccauuaccauggcacgcaggugcugauacuggcacaccacauuggaacaacaaagaagcacucguugaauucaaagacgcccaugcaaaacgacaaacaguagucguuuuaggaucacaagaaggagccguacacacugcauuagcaggagcauuagaagcagaaauggauggcgccaaagggagacuaucgaguggucaucuuaagugcagacuaaaaauggauaaauuaagguuaaaaggaguaaguuacucucuaugcacagcagcauuuacauuuacuaaaauaccugcugagacauuacauggaacuguaacuguagaaguacaauacgcagggacugauggaccauguaaagugccagcacaaauggcaguagauaugcaaacauuaacaccaguaggacgauuaauaacggcaaauccaguaaucacugaaucaacugaaaauaguaaaaugauguuagaguuagauccaccauucggcgauaguuauauaguaauaggagugggcgaaaaaaaaaucacucaucauuggcacagaagcggcaguacauuaggaaaagcauucagcacaacauuaaaaggagcucaaagauuagcagcacuaggugauacagcaugggauuucggaucaauuggaggaguauucaauucaauagggagagcagugcaucaaguauucgguggcgcauuuagaacucuguucggaggaaugaguuggauaacacaaggacuaaugggugccuuauuauuauggaugggaguaaaugcacgagaccgaucaauagcacuagcauuucuagcaacuggagguguauuaguauuucuggcaacuaacguccacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6901 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccaguguaggaauaguagguuuacuccuuaccacagcaauggcggcagaaguaacacggagaggaucugcauauuacauguaccuugacagaaaugacgcgggagaagcaauaaguuucccaacaacacuagggaugaauaaaugcuacauucaaauuauggaucuaggacauacaugugaugcgacgaugagcuaugaaugcccaauguuagaugaagguguagaaccagaugauguagacugcugguguaauacuacaucgaccuggguuguauauggaacaugucaucauaagaaaggagaagcacgaagaagcaggagagcaguaacauuacccagucauucaacaagaaaauuacaaaccagaucacaaacauggcuagaaucaagagaauauacaaaacauuuaauaagaguagaaaacuggauuuuuagaaauccaggauuugcauuagcugcugcagcuauagcauggcuucuuggcaguucaaccagccaaaaaguuauauauuuggucaugauuuugcuaauagcaccagcauauaguauacgauguauaggaguaucaaauagagacuuuguugaaggaaugucuggaggaacaugggucgauguaguacuagaacauggaggauguguaacaguaauggcacaagauaaaccaacaguugauauagaauuaguaacaacaacaguaucgaauauggccgaaguaagaaguuauuguuaugaagcaucaauauccgauauggcaucagauagcagauguccaacucaaggagaagcauaccuagauaaacaaucagauacucaauauguuuguaaaagaacauuaguugacagaggcugggguaauggaugcgguuuauucggcaaaggcucauuaguaacaugugcaaaguuugcauguucaaagaaaaugacaggaaaaucaauacaaccagaaaauuuagaauaucgaauaauguuaaguguacauggaucccagcacucaggaaugauaguuaaugauacaggucacgaaaccgaugagaauagagcaaaaguagagauaacuccaaauaguccaagagcagaagcuacauuaggaggauuugguagcuuagguuuagauugugaaccacgaacaggauuagauuucagugaucuauauuaucuaacuaugaauaauaaacacugguuaguacauaaagaaugguuucaugauaucccacuuccauggcaugcaggagcagauacaggaacaccccauuggaauaauaaagaagcauuggucgaauuuaaagaugcacaugcaaaaaggcaaacaguuguaguguuaggaucacaagaaggagcuguacacacagcacuugcuggugcacuugaggcagaaauggauggagcaaaaggaagacugagcagcgggcauuuaaaauguagauugaaaauggauaaauuacgccugaaaggaguaaguuauagucuauguaccgcagcauuuacauuuacaaaaauaccagcugaaacgcuacauggaacggucacaguagaaguacaauaugcagguacagauggaccauguaaaguaccagcacaaauggcaguagacaugcaaacacuaacaccaguuggaagauugaucacugcaaauccaguuauaacagaaucaacugaaaauucgaaaaugauguuagaguuagacccuccguuuggugacucauauauaguaaucggaguaggagaaaagaaaauaacacaucacuggcauagaucaggaaguacacuaggaaaggcuuuuagcacaacauuaaaaggugcucaaagauuagcagcauuaggcgauacagcuugggacuuuggaucaauaggcggaguauuuaacaguauaggaagggccguacaucaaguauuuggaggagcauuuagaacacucuuuggaggaaugagcuggauaacacaagguuuaaugggagcauuauuacuuuggaugggaguaaaugcacgagaucgaaguauagcauuagcauuucuagcaacugguggaguccuaguauuucuagcaacaaacguacaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6902 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugacaucaauagguaucauaggccuauuacuaacuacagcaauggcagcagaaauaacuagaagagguucagcauauuacauguaucuagauagaagugaugcagguaaagcaauaaguuuugcaacaacauuaggaguaaauaaaugccauguacaaauaauggaucuaggucauaugugugacgcaacaaugaguuaugaaugcccuaugcuagacgaaggaguugaaccugaugacguagauuguuggugcaacacaacaaguacuugggugguauauggaacuugucaucacaagaaaggagaagcaagacgaucaagacgagccguaacucuaccaucucacucaacaagaaaacuacaaacacgcucacagacaugguuagaaucaagagaauacacuaaacauuuaauuaaaguugaaaacuggauuuuucgaaauccagguuuugcauuaguagcuguagccauagcauggcuacuaggaaguucuacaucucaaaaaguaauauaucuuguaaugauacuacuaauagcuccagcauauucaauuagauguauaggaguaagcaauagagauuucguagaaggaaugaguggaggaacauggguagauguaguauuagaacauggugguuguguaacaguaauggcacaagacaaaccaacagucgacauagaauuaguuacaacuacgguaaguaacauggcagaaguuaggaguuauuguuaugaggcaucaauaagcgauauggcgucagauucaagaugcccaacacaaggagaagcauauuuagacaaacaaagugauacgcaauacguauguaaaagaacucuaguagacagggguuggggaaauggaugcgguuuauuuggaaaaggcagucuaguaacaugcgcaaaauuuacauguucaaagaaaaugacaggaaaaucuauucaaccugagaauuuagaauaucgaauaauguuaucuguacauggaucucaacauucaggaaugauaggguaugaaacugacgaagauagagcaaaaguagaaguaacgcccaauucuccaagagcagaagcaaccuuaggcggauuuggaaguuuaggacuagauugugaaccaagaacaggucuagacuuuucagaucucuacuaucuaacaaugaauaauaaacacuggcuugugcauaaggaaugguuucaugauaucccauuaccauggcaugcaggagcagacacaggaacaccucauuggaauaauaaagaggccuuaguagaauuuaaagaugcacaugcgaaaagacaaacaguaguaguuuuaggaagucaagagggagcaguucauacagcauuagccggagcacuugaagcggaaauggauggagccaaaggacgucuauuuaguggacacuuaaaaugcagauuaaaaauggauaaacuuagacuaaaaggugucucauacucucuaugcacagccgcguuuacauuuaccaagguaccagccgaaacacuucacggaaccguaacuguagaaguacaauaugcaggaacagauggaccauguaaaauuccuguacaaauggcaguagauaugcaaacauuaacacccguagguagauuaauaacagcaaaucccguaauuacagaaucaacagaaaauaguaaaaugauguuagaacuagauccuccauuuggagauucauauauaguaauaggaguaggugacaagaaaauaacacaucauuggcacagaagugguagcacauuaggaaaagcauuuaguacaacacucaaaggagcacaaagauuagcagcacuaggagauacagcaugggacuuuggaagcauuggagguguauuuaauaguaucgguagagcaguucaucaaguguuuggaggagcauucagaacacuauuuggagguaugucuuggauuacacaagguuuaaugggugcauuauuauuguggaugggaguaaaugcacgagaucguucaauagcauuggccuuuuuagcaaccgguggaguccugguguuuuuagcaacuaauguccaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6903 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugacaucuguagguauaguaggacuccuuuuaacaacagcaauggcagcagaaguaacgagaagagguagcgcauauuauauguauuuagauagaaacgacgccggagaagcaauuagcuuuccuacaacauuaggcaugaauaaauguuauauacaaauaauggaccuuggacauaugugugaugcaacuaugagcuaugaaugcccuaugcuagaugagggaguagaaccagaugacguagauuguugguguaacacaacaagcacaugggucguuuauggcacaugccaucauaaaaaaggagaggcaagacguagucgaagagcaguaacacuaccaucgcauucaacacgaaaauuacaaacuagaagccaaacauggcuagaaucacgagaguacacaaaacauuuaauaagaguagaaaacuggaucuuuaggaauccugguuuugcacuagcagcagcagcaaucgcauggcuacucggaaguaguacgagucaaaaaguaaucuaucuaguaaugauuuuacuaauagcacccgcuuacucaauaagguguauagguguaucaaauagagauuuuguggaagguaugagugguggaacauggguugauguaguacuagaacauggaggaugugucacaguuauggcucaagauaaaccaaccguugauauagaguuaguuacuacuaccguuuccaauauggcagaaguaagaagcuacugcuaugaagcaagcaucucagauauggcaucagauucaagaugcccaacccagggagaagcauauuuagacaaacaaucagauacacaauauguaugcaaaaggacauugguugauagaggaugggguaauggaugcggauuauuuggcaaaggaucucuaguaaccugugcuaaauucgcaugcucuaaaaaaaugacaggaaaaucgauucaaccggaaaaucuugaauaccgaauaaugcuuucaguacauggaagccaacauucaggaaugaucguaaacgauacaggucacgaaacagaugagaauagagcuaaaguagaaauaacuccaaauagcccacgugcugaagcuaccuuaggaggauuugggucuuuaggauuagauugcgaaccacgaacaggauuagauuucucagaccucuauuaucucacaaugaacaauaaacauugguuaguccauaaagaaugguuccaugacaucccacuaccauggcacgcaggugcggacacuggaacaccgcacuggaacaacaaagaagcacuagucgaauucaaggaugcucacgcaaaaagacaaacaguaguaguacugggaucacaagaaggagcaguacacacagcuuuagcaggagcauuagaagcagaaauggacggagcaaaaggaagauuaagcagcggacaucuuaaauguagauuaaaaauggauaaauugagauuaaaaggagucucguauucauuaugcacagccgcauuuacauuuacaaaaauacccgccgaaacacuacauggaacaguuacugucgaaguacaauaugcagggacagacgguccauguaaaguaccugcacaaauggcaguugacaugcaaacacuaacaccaguaggaagauuaaucacagcaaacccaguaauaacagaaucuacagaaaacaguaaaaugauguuagaauuagauccaccuuuuggcgauuccuauauaguaauuggaguaggagaaaaaaaaauuacacaucauuggcauagaagugguucaacacuaggcaaagcuuuuucaaccacacuaaaaggugcucagcgacuagcagcacuuggagauacagcaugggauuucggaaguaucggaggagucuuuaacucaauaggucgagcaguucaucaaguauucggcggagcauuuagaacacuauuugguggaaugucauggauaacacaaggacuaaugggagccuuauuauuauggaugggaguaaaugcgagagauagaaguauugcauuagcauuuuuagcaacugguggaguacuaguauuuuuagcaacuaacguacaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6904 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugagaauuauaaacgcucgaaaagaaaaaaaaagacgaggagcagauacaaguguugguauaguagguuuauuguuaacuacugcaauggcagcagaaguaacaagacgaggaagcgcuuauuauauguaucuagacagaaaugaugcaggagaagcgauaaguuucccaacuacauuagguaugaauaaauguuacauacaaauaauggauuuagggcauaugugugaugcaacaaugaguuaugaaugcccaauguuagaugagggaguagaacccgaugacguagauugcuggugcaacacuacaagcacauggguaguauaugguacaugucaucauaaaaaaggcgaagcaagaagaagccgaagagcaguuacacuaccaucacauucaacaagaaaacuucaaacgcgaucacagacuuggcuagaaucaagagaauauacaaaacaucuaauuaggguagaaaauuggaucuucagaaacccaggauuugcgcuagcagcugcugcuauugcuugguuauuaggaucaucaacaagccaaaaaguaauuuaucuugugaugauucuacuaauugcacccgcauauucuauacgcugcauaggagugucgaaccgagauuuugucgaaggaauguccgggggaaccuggguagauaucguauuagaacauggagguuguguuacugugauggcacaagauaaaccaacaguagauauagaauuaguuacaacaacaguaagcaauauggcagaaguuagauccuacuguuaugaagcauccauuagcgauauggcuagugauagcagauguccaacacaaggagaagcuuacuuagauaaacaaagugacacacaauauguaugcaaaaggacauugguagaccgaggauggggcaauggaugcgguuuauucgguaaaggcucauuaguaacuugugcaaaauuugcguguucaaaaaaaaugacaggaaaaaguauacaaccagaaaauuuagaauacagaauaauguuaucaguacacggaucccaacacucaggaaugauaguaaaugacacaggacaugaaacagaugaaaacagagcaaaaguagagauaacaccaaauucaccaagagcugaagccacauuaggaggauucggaaguuuagguuuagacugugaaccaagaacuggauuagauuuuagcgacuuauauuauuuaacaaugaacaauaaacauugguuaguacauaaagaaugguuucaugauauaccauuacccuggcaugcaggagcugauacagggacuccccauuggaacaauaaagaagcacuuguagaauucaaggaugcacaugcgaaaagacaaacaguaguagucuuaggcagccaagaaggggcaguucacacagcauuagcaggagcuuuagaagcggagauggauggcgcaaaaggaagauuaagcucaggccacuuaaaaugcagguuaaagauggacaaauuaagauuaaaaggaguaaguuauagccuaugcacagcagcauuuacauucacuaaaauaccagccgaaacauuacacggaaccguuacuguugaaguacaauacgcaggaacagacggacccugcaaaguaccagcucaaauggccguagauaugcaaacauuaacucccguugggagacuaauaacagccaauccaguaauaacagaaaguacugaaaauucaaaaaugauguuagaauuagauccaccuuuuggagacucauacauaguuauagguguaggggaaaagaaaauaacacaccacuggcacagaucaggcucaacuauugguaaagcauuugaagcuacagucagaggcgcgaaaagaauggcaguacuaggagauacagcaugggauuucggaucaguuggaggggcauuaaacaguuuaggaaaaggaauacaucaaaucuucggagcagcuuucaaaucuuuauuuggagguaugucuugguuuucucagauacuaauagguacauuauuaaugugguuaggacuaaauacaaaaaaugggucaaucucuuugauguguuuagcacuagguggaguguugauauuuuuaucaacagcaguaagugcagacguagguuguucaguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6905 - RNA, 2521 nt, Artificial Sequence
  ZIKV prME variant mRNA Design 2 opt
ggggcgcugccuacggagguggcagccaucuccuucucggcaucaagcuuaccaugauaauuaacgcuaggaaagaaaaaaaacgaagaggggcagauacauccguaggcauaguagguuuguuauuaacaacagccauggcagcagaaguaacacgaagaggcucagcauacuacauguauuuagauagaaaugaugcaggagaagcaauaagcuuuccaacuacauuaggaaugaauaaauguuauauacaaaucauggaucuaggacacaugugugaugcgacaaugucauaugaaugcccaauguuggaugaaggaguugaaccagaugaugucgauugcugguguaauacaacaaguacauggguaguauauggaacaugccaucauaaaaaaggagaagccagaagaagcagacgcgcaguaacacucccaucucauaguacaagaaaacuacaaacaagaucucaaaccuggcuagagagcagagaauacacaaaacauuuaauaagaguagagaauuggauuuucagaaauccuggauuugcccuggcagcagcagcuauugcauggcuacuugguucgagcacgagccaaaaaguaaucuaucucguuaugauacuacuaauagcuccagcuuacagcauaagauguauuggaguaucaaauagagauuuuguagaagguaugucaggaggaacauggguagauaucguuuuagaacauggaggauguguaacaguaauggcgcaagacaaaccaacgguagacaucgaauuaguaacaacgacaguaaguaauauggcagaaguaagaaguuacugcuacgaagcaaguauuucagauauggcaucagacucacgauguccaacacaaggagaagcauauuuggauaaacaaucagacacacaauauguaugcaaaagaacacuaguagacagaggaugggggaacggauguggacuuuuuggaaaagguucuuuaguaacaugugcaaaauuugcgugcucaaaaaagaugacaggaaaaaguauacaaccagaaaaucuugaauauagaauaauguuaucaguacacgggagccagcauagcggcaugauaguuaacgacacuggacacgaaacagacgaaaacagagcuaaaguagaaauaaccccaaauagucccagggcagaagcaacguuaggaggauuuggaaguuuaggacuagacugugaaccacgaacaggacuagauuuuagcgaucuauacuacuuaacaaugaacaacaaacacuggcuaguccauaaagaaugguuucaugacauaccguuaccauggcaugcaggagccgacaccggaacuccacauuggaauaacaaagaggcauuaguagaauuuaaagaugcacaugcaaaaagacagacuguaguaguacuaggaagucaagaaggagcuguacacacagcacuugcaggagcauuagaagcagaaauggacggagcaaaagggcgguugucauccggacaucuaaaaugucgauuaaaaauggacaaauuaaggcuuaaaggaguaucuuacagucuaugcacagcagcauuuacauuuacaaaaauaccagcagaaacauuacaugguacaguaacaguugaaguacaauaugcaggaacagauggcccauguaaaguuccagcacagauggcaguagauaugcaaacuuuaaccccaguaggaagauugauaacagcuaaucccguaauaacagaaaguacagaaaauucaaaaaugauguuagaacuggauccaccauuuggagauagcuauauaguaauaggaguaggagagaaaaagauaacacaucauuggcacagaaguggaagcacaaucggaaaagcuuuugaagcaacgguaaggggcgcaaaaagaauggcaguauuaggagacaccgcgugggauuuuggaagcguaggaggagcauuaaauaguuuaggaaaaggaauacaucaaaucuucggagcugcauucaaaucauuauuuggugguaugucaugguuuucacaaauacuaauagguacccuucuaaugugguuaggauuaaauaccaaaaacggcagcauaagcuuaauguguuuagcauugggugguguuuuaauuuuuuuaucuacagcaguuucagcagaugucgguuguagcguggauuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6906 - RNA, 2518 nt, Artificial Sequence
  ZIKV prME variant mRNA Design 2 opt
ggggcgcugccuacggagguggcagccaucuccuucucggcaucaagcuuaccaugauaaaugcaagaaaagaaaaaaaacgaagaggagcagacacaagugucggaauaguagguuuauuauuaacuaccgcaauggcggcagaaguaacgagaagaggaucugcauauuacauguauuuagaucguaaugaugcuggagaagcaauaucuuucccaacaacacuaggaaugaauaaaugcuauauucaaauaauggaccuaggacauaugugcgaugcaacaaugaguuaugaauguccaauguuagacgaaggaguagaaccagacgauguggacuguugguguaauacaacuagcacguggguagucuacggaacaugccaucauaaaaaaggggaagcaagaagaaguagacgagcaguaacguuaccaucacauagcaccagaaaauuacaaaccaggucacaaacuuggcuagaaucacgagaauacacaaaacaucuaauuagaguagaaaacuggauauuucgaaacccgggauuugccuuagcugcagcagcaauagcauggcuauuaggaucaaguacuucacaaaaaguaauuuaucuaguaaugauacuauuaauagcgccagcauauucaauaagguguauuggaguuagcaauagagauuuuguagaaggaaugaguggaggaacuugggucgauaucguacuagaacauggaggauguguaacaguaauggcacaagacaaaccaacaguagauauagaacuaguuacaacaacaguaaguaauauggccgaagugagaagcuauuguuaugaagccucaauaucagauauggcaagugacucaagguguccaacucaaggagaagcauaucuggauaagcaaucagacacacaauaugucuguaaaagaacguuaguagauagagguuggggaaauggauguggucucuucggaaaaggaucauuaguaacaugugcaaaauuugccugcagcaaaaaaaugacaggaaaaagcauacaaccugaaaaccuggaauauagaauaaugcucucaguacaugguagccaacauucagguaugauagugaaugauacaggacaugaaacugaugaaaaucgagcaaaaguagaaaucacgccuaauaguccgagagcugaagcuacacuaggaggauuuggaaguuuaggauuagacugugaaccaagaacaggauuagauuuuagugaccucuacuauuuaacaaugaauaauaaacauuggcucguacauaaagagugguuucacgacauaccauuaccauggcacgcaggugccgauacaggaacuccgcauuggaauaacaaagaagcauugguugaauuuaaagaugcacaugcaaagagacaaacaguaguuguuuuaggaagccaagaaggagcaguccacacagcuuuagcaggagcuuuagaggcagaaauggauggagcaaaaggaagacuuagcucuggccaccuaaaaugcagauugaaaauggauaaacugagacuaaaaggaguaucuuauagucuauguacagccgcauucacauuuacuaaaauuccagcagaaacuuuacaugguacaguaacuguagaaguucaauaugcaggaacagauggcccuuguaaaguaccugcccaaauggccguagauaugcaaacauuaacaccaguaggaagauuaauaacagcaaauccaguaauaacagaaagcaccgaaaauagcaaaaugauguuagaauuagauccaccauuuggugauaguuauauaguaauuggaguaggcgaaaaaaaaauaacacaucacuggcauagaucagggucaacaauagguaaagcauuugaagccacaguaagaggagcaaaaagaauggcaguuuuaggagauaccgccugggacuuugguucaguaggaggagcucuuaauucuuuaggaaaaggaauacaccaaauauuuggcgcagcauuuaagaguuuauucggaggaaugucaugguuuucacaaauucuaauaggaacguuauuaauguggcuagguuuaaauacaaaaaaugggagcaucucccuaaugugucuugcauuaggaggaguacuuauauuuuuaagcacugcaguaagugcggacguagguuguaguguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6907 - RNA, 2515 nt, Artificial Sequence
  ZIKV prME variant mRNA Design 2 opt
ggggcgcugccuacggagguggcagccaucuccuucucggcaucaagcuuaccaugaacgcuagaaaagaaaaaaaacguagaggugccgacacaagcguaggaauuguaggguuauuauuaacaacagcaauggcagcugaaguaacuagaagagguucagcauacuauauguacuuagauagaaaugacgcuggagaagcaauaaguuuuccaacaacauuagguaugaauaaauguuauauacaaauaauggaucuuggucauaugugcgaugccacaaugucguacgaauguccaaugcuagaugaaggagucgaaccagaugauguagauuguugguguaacacaacaagcacuuggguaguguaugguacaugucaucacaaaaaaggagaggcaagaagaaguagacgggcuguuacacuucccagccacucuacgagaaaacuacaaacacgaagucaaacauggcuagaaucaagagaauacacaaaacaccuaauaagaguagaaaauuggauauuuagaaauccaggguucgcucuugcagcagcagcaauagcauggcuauuaggaaguaguacuagucaaaaagugauauaucuaguaaugauacuuuuaauagcgccagccuacagcauaagauguaucggaguaaguaauagagauuuugucgaaggaaugucuggagguacuuggguagacauaguacuagaacacgguggaugcgugacuguaauggcacaggacaaacccacaguagacauugaauuaguaacaacaacaguaucaaacauggcagaaguaagaucauauuguuaugaagcaaguauaagugauauggcaucagauagucgauguccaacacaaggagaagcuuauuuagauaaacaaagugauacgcaauacguauguaaaagaacgcuaguagacagggguuggggaaacggaugugguuuauucgguaaggguucauuaguaacaugugccaaauuugcauguaguaaaaaaaugacuggaaaaucuauacaaccugaaaauuuagaauacagaauuauguuaucgguucauggaagccagcacagcggaaugauaguuaaugauacaggacaugaaacggaugaaaauagagcaaaaguagaaauaacaccaaacaguccaagagcagaagcaacauuaggaggauuuggaagcuuaggauuggauugugagccgagaacaggauuagauuuuagcgaucuauacuauuuaacaaugaauaacaaacauugguuaguacauaaagaaugguuucacgauauuccacuaccguggcaugcaggagcagauacagguacaccgcauuggaauaacaaagaggccuuaguugaguucaaagaugcucaugcuaaaagacaaacggucguaguacuaggaucacaagaaggagcaguacacacagcacuagcaggagcucuugaagccgaaauggauggugcgaaaggacgauuaucaaguggacauuuaaaaugcagacuaaaaauggauaaauugagauuaaaaggaguaaguuacagcuuauguacagcugccuuuacuuucacaaaaaucccagcugaaacauuacauggaacaguuacaguugaaguucaauaugcaggaacagaugguccauguaaaguaccagcacaaauggcaguagauaugcaaacauuaacuccaguaggaagauuaauaacugccaauccuguaaucacagaaaguaccgaaaauucaaaaaugauguuagaauuggauccgccauuuggagauucuuauauagucauagguguaggugaaaaaaaaauaacacaucauuggcauagaagugguucaacaauagguaaagcauucgaagcaacaguaaggggagcaaaaagaauggcaguacuaggagauacagcuugggacuuugguagcgucggaggugcuuuaaauagcuuaggaaaagguauucaucaaauauuuggugccgcauuuaaaaguuuauucggagggaugaguugguuuagucaaauacucauuggaacucuuuugauguggcuaggauuaaacacaaaaaauggaaguauuucacuaauguguuuagcauuaggaggaguauuaauauuccuaucuacagcagucucagcugauguaggaugcucagucgacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6908 - RNA, 2512 nt, Artificial Sequence
  ZIKV prME variant mRNA Design 2 opt
ggggcgcugccuacggagguggcagccaucuccuucucggcaucaagcuuaccauggcaagaaaagaaaagaaaaggagaggagcagacacaaguguaggaauaguagguuuauuacugacuacggcaauggcagcagaaguuacaagaaggggaagcgcauauuauauguauuuagauagaaaugaugcaggagaagcaauaucauucccaaccacauuaggaaugaacaaauguuacauacaaauaauggaccucggacauaugugcgaugccacaaugucauaugaaugcccgauguuagacgaaggaguagaaccagaugauguagauuguugguguaauacuacuagcacauggguaguauacggaacaugccaucauaagaaaggagaagcucgaagaucuagaagggcuguaacuuuacccucacauucaacacguaaauuacagacaagaagccaaacauggcuagaaucaagggaauauacaaaacacuuaauuagaguagaaaauuggauauucagaaauccaggauucgcguuagcagccgcagcgauagcuugguuauuaggaucaaguacaucucaaaaaguaauauaucuagucaugauacuacuaauagcgccagcuuacaguauaagaugcauaggaguaaguaacagagacuuuguagaaggaaugucaggaggcacauggguagacauaguacuagaacaugguggauguguaacagugauggcacaagacaaaccaacaguagauauagaauuaguaacaacgacaguaagcaauauggcagaaguaaggaguuauuguuaugaagcaucaauuucagauauggcaagcgauucaagaugucccacucaaggugaagcauaucuagauaaacaaagcgauacgcaauauguauguaaaagaacuuuaguagaucgaggcugggguaacggaugcgguuuauuuggaaaagggagcuuagucacaugugcaaaauucgcauguucgaagaaaaugacuggaaaaaguauacaaccugaaaaucuagaauacagaauuauguuaucaguacauggaagucaacauaguggaaugauuguaaacgauacaggucaugaaacggacgaaaaucgcgcaaaaguagaaauaacaccuaauaguccacgagcagaagcuacuuuaggggguuucgggucauuaggauuggacugugaaccaagaacagguuuagacuuuagugaccuauauuacuuaacaaugaacaauaaacacugguugguacacaaagaaugguuucaugacauaccauuacccuggcaugcaggagcagacacuggaacuccacauuggaauaauaaagaagcgcuaguagaauuuaaagaugcacaugcaaaaagacaaacuguaguuguccuaggaucacaagaaggagcaguacauacagcauuagcuggagcauuagaggcagaaauggauggagcaaaaggaagauuauccagugggcaucuaaaaugcagguuaaaaauggauaaacuuaggcuaaaaggaguaucuuacucacuauguaccgcugcauucacauuuacaaaaauuccugcagaaacauuacauggaacagugacaguagaagugcaauaugcuggaacugacgguccauguaaaguuccagcacaaauggcaguagauaugcaaacauuaacuccuguagguagacuuauaacagcaaacccaguaauaacagaaaguacagaaaauucaaaaaugaugcuagaauuagauccaccauucggagauagcuauauagugauuggaguaggugaaaagaaaauuacacaccacuggcacaggagugguaguacaauaggaaaagcguuugaagcaacuguaagaggugcaaaaagaauggcugucuuaggugacacugcaugggauuuugguaguguuggaggagcuuuaaauucacuaggaaaagguauacaccaaauauucggagcagcauuuaaaagucuauuuggcgguauguccugguuuucacaaauauuaauaggaacguuauuaaugugguuaggacuaaacacgaaaaauggaagcauaucauugauguguuuagcucuaggaggaguuuuaauauuucuuucaacagcagucucagcagauguuggauguucaguagacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6909 - RNA, 2509 nt, Artificial Sequence
  ZIKV prME variant mRNA Design 2 opt
ggggcgcugccuacggagguggcagccaucuccuucucggcaucaagcuuaccaugagaaaagaaaaaaaaagacgaggagcagacacaucagucggaauuguaggacuacuuuuaacaacagcaauggcagcagagguuacuaggagagguucagccuauuauauguauuuagauagaaacgaugcuggcgaagcaauuaguuuccccacaacauuaggaaugaauaaauguuauauacaaauuauggauuugggucauaugugcgacgcaacaaugaguuaugaaugccccaugcuggaugaaggggucgaaccagacgauguagauuguugguguaacacaacaucaaccuggguaguauacgggacaugucaucacaaaaaaggagaagcgagacgaagcagaagagcaguuacacuaccaagucacucaacacgaaaacuacaaacacgaucacaaacaugguuagaaaguagagaguacacaaaacaucuuauucgaguagagaauuggauauuuaggaauccaggauuugcauuagcagcagcagcaauagcaugguuauuagguucaucaacaagucaaaaaguaauauaccuuguaaugauacuacuuauagcaccugcuuauaguauaagauguauuggaguaucaaauagagacuuugucgaaggaaugaguggaggcacguggguagauauaguauuagaacacggaggauguguaacagucauggcacaagacaaaccuacaguagacaucgaacucgucacuaccacaguaucaaauauggcagaaguaagaucauacuguuaugaagccaguauaagugauauggcaagugacucaagauguccaacacaaggugaagcauaucucgauaaacaauccgauacucaauauguauguaaaagaacauuaguagauagaggauggggcaauggauguggacuuuuuggaaaagggucacuaguaacaugcgcaaaauuugcauguaguaaaaaaaugacagguaaaucaauacaaccagaaaaccuugaauaucgaauaauguuaaguguucauggaagccaacacucgggcaugaucgugaacgacacagggcacgaaaccgaugagaauagagcaaagguagaaauaacaccaaauagcccaagagcagaagcuaccuuaggaggauucggaucauuaggcuuagauugugaaccaagaacaggguuagacuuuucagaucuauacuaucuaaccaugaauaauaaacauuggcuaguucacaaagaaugguuucaugauauaccauuaccauggcacgcaggagcagacacgggaacaccacauuggaacaacaaagaagcauuaguggaauuuaaagaugcacacgcaaaaagacaaacuguugugguacuaggaagucaggaaggagcaguacauacagcauuagcgggagcgcuagaagcagaaauggauggagcaaaaggaagacuaucaucuggucacuuaaaauguagauugaaaauggauaaguuaagauuaaaggggguuagcuauucucuauguacagcggccuucacuuuuacaaaaauuccggcagaaacacugcauggaacaguaacaguagaaguccaguaugcagguacagacggaccauguaaaguacccgcccaaauggcaguagauaugcaaacauugacuccaguaggaagacucauaaccgcuaauccgguuauaacagagaguacagaaaacucaaaaaugaugcuagaacucgauccgccauucggagauucguauauaguuauagguguuggagaaaaaaaaauaacacaccauuggcauagaucaggcuccacaauaggaaaagccuuugaagcuaccguaaggggagcaaaaagaauggcaguauuaggagauacugcaugggauuucggaucaguuggaggagcacuaaauagcuuaggaaaaggaauacaucaaauauuuggagcagcauuuaaaucuuuguuuggaggaaugucaugguucagucaaauauuaauaggaacguuauuaaugugguuaggucugaauaccaaaaauggaagcauuaguuuaauguguuuagcauuaggaggaguauuaauauuucuaucgacagcuguaucagcagauguggguuguucaguagauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6910 - RNA, 2506 nt, Artificial Sequence
  ZIKV prME variant mRNA Design 2 opt
ggggcgcugccuacggagguggcagccaucuccuucucggcaucaagcuuaccaugaaagaaaaaaaaagaagaggagcagauacaucaguaggaaucguaggauuacuauugacaacagcuauggcagcagaaguaacaagaagaggaucggcauauuauauguauuuagaucgcaacgaugcuggagaagcaauuucauucccaaccacuuugggaaugaauaaaugcuacauacaaauaauggauuugggacauaugugugacgcgacuaugucauacgaguguccgaugcuagaugaaggaguagaaccugaugacguagauuguugguguaauacuacaagcacuuggguagucuaugguacgugccaucauaaaaaaggugaagcucgaagaagcagaagagcaguuacuuuaccuucacacucaacaagaaaauuacaaacgagaagucaaacaugguuagaaucaagagaauauacaaaacauuuaauaagaguugaaaauuggauauuuagaaauccugguuuugcauuagcugcggcagcaauagccugguuauuaggaucaucaacuagucaaaaaguaauuuauuuaguaaugauuuuauuaauagcaccugcguauaguauaagauguauaggaguaaguaauagagauuuuguagaagguaugucaggaggaacauggguagacauaguauuggaacauggggggugcguaacagucauggcucaagacaaaccaacaguagacauagaauuaguuacaacaacuguauccaauauggcagaaguaagaagcuauuguuacgaagcuucuauaagcgacauggcuucagauucaagauguccuacacaaggugaagcauauuuagacaaacaaagugauacccaauacguaugcaaaagaacauugguggauagaggaugggguaauggaugcggauuauuuggaaagggaucacuaguaacaugugcaaaauuugcauguagcaaaaaaaugacaggaaaaaguauacaaccggaaaaucuagaauauagaauaauguuaucgguacacgguagucaacauucaggaaugauaguaaaugauacaggacaugaaacagaugagaacagagcuaaaguugaaauuacaccgaauucuccaagagcagaagcaacgcuaggaggauuuggaagucuagguuuagauugcgaaccaagaacagguuuagacuucagugacuuauacuacuuaacaaugaacaauaaacauugguuaguacacaaagaaugguuucaugauauaccacuaccauggcaugcaggagcggauacuggaacaccacacuggaacaauaaagaagcauuaguagaauuuaaagaugcacaugcaaaaagacaaacaguaguagugcucgguucacaagaaggagcagugcacacagcauuggccggagcacuagaagcagaaauggauggagcaaaaggaagacuaucaucaggacaucuaaaaugcaggcuaaaaauggauaagcuuagauuaaaaggaguaucauauucacugugcacagcagcuuucacauucaccaaaauuccugcagaaaccuugcacgguaccguaacaguagaaguacaguaugccgggacagauggaccauguaaaguaccagcgcaaauggcggucgauaugcagacucuaacaccagugggaagguuaauaacagcuaaucccgugauaacagaaucaacagaaaauaguaaaaugauguuagaacuagauccuccauuuggagauucauacauaguaauaggaguuggagaaaaaaaaauaacacaucacuggcauaggagcggcucaaccauuggaaaagcauucgaagcuacaguaagaggcgcaaaacguauggcaguauuaggagauacagcaugggauuuuggaucaguuggaggugcauuaaacucacucggaaaaggaauacaucaaauauucggagcugcuuucaaauccuuguucggagguaugaguugguuuucucaaauauuaauaggaacacuauugaugugguuaggauuaaauacaaaaaacggaagcauaucauuaauguguuuagcauuagggggugucuuaauuuucuuaucaacagcagugucagcagaugucggguguagcguugauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6911 - RNA, 2503 nt, Artificial Sequence
  ZIKV prME variant mRNA Design 2 opt
ggggcgcugccuacggagguggcagccaucuccuucucggcaucaagcuuaccauggaaaagaaaagaagaggagcagauacaucagugggaauuguagggcuauuauuaacaaccgcaauggcagcagaaguaacaagaaggggaagcgcauacuauauguauuuagaccguaaugacgcuggagaagcgauuuccuuucccacaacauuaggaaugaauaaaugcuacauacaaauaauggacuuaggacauaugugugaugccacaaugucauacgaauguccaaugcuugacgaaggaguagaaccagaugacgucgacuguuggugcaauacaacaucuacuuggguuguuuaugggacuugucaucacaagaaaggagaggccagacgaagucguagagcaguaacuuuaccaagccacucaacaagaaaacuacagacuagaagucaaacgugguuagaaucaagagaauauacaaaacauuuaauacgaguggaaaacuggauauucagaaacccuggauucgcauuggcagcagcugcaauugcaugguuauuaggaucaaguacaucacaaaaaguaauauauuuaguuaugauauuacuaauugcacccgcuuauucaauaagauguauaggaguaucuaacagagauuuuguugaaggcaugagcggaggaacauggguagauauaguauuggaacaugggggaugcguuacaguaauggcacaagauaaaccaacaguggauauagaauuagucacaacaacaguuaguaacauggcagagguacgaucuuauuguuacgaagcaaguauaagugauauggcaucggauaguagauguccuacacaaggagaggcuuauuuagacaaacaaagugauacacaauauguuuguaaaagaacacuuguugauagagguugggguaacgguugcggauuauuugguaaaggcucacugguuacgugugcaaaauucgcauguagcaagaaaaugacuggaaaaaguauacaaccagaaaaucuagaauauagaauaauguuaaguguacacggaagccaacauucaggaaugauaguaaaugacacaggacacgaaacagacgaaaauagagcaaaaguugaaaucacuccuaauucaccaagagcagaagcaacacuaggagguuuuggaucucuaggccucgacugugaaccacgcacaggauuagacuuuucagacuuauacuaucuuacaaugaauaacaaacauuggcuaguacauaaagaaugguuccacgacauuccacuaccauggcacgcaggagcagacacaggaacaccacauuggaacaacaaagaagcacuuguagaauuuaaagaugcccaugccaaaagacaaacaguaguaguauuaggaucacaagaaggcgcuguacauacugcccuagccggcgcacuagaagccgaaauggauggcgcaaaaggaagacuaucaagugggcauuuaaaauguagacuuaaaauggauaaacugcgacuaaaaggaguaucguacucauuauguacggcagcuuuuacauuuaccaaaauaccagcagaaacacuacacggaacuguaacgguggaaguucaauacgcuggcacagauggaccuuguaaaguaccagcacaaauggcaguagacaugcaaacuuuaacaccaguaggaaggcuaauaacagccaacccgguaauaacugaaaguacagaaaauucaaaaaugaugcuagaauuagauccuccguucggagauagcuacauaguaauugguguaggagaaaagaaaauaacccaucauuggcaccgaaguggaucuacaaucggaaaagcauucgaagcaacaguaagaggagccaaaagaauggcuguacuuggggauacagcaugggauuuuggaucaguagggggagcgcucaauaguuuaggaaaaggaauacaucaaauauuuggagcagcuuuuaaaaguuuauuuggaggaaugaguugguucucacaaauauuaauagguacccuacuaaugugguuaggacuuaauacuaaaaauggaaguauaucauugauguguuuagcauuagguggaguucuaauauuuuuaucaacagcaguaagugcagauguagguugcucaguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6912 - RNA, 2500 nt, Artificial Sequence
  ZIKV prME variant mRNA Design 2 opt
ggggcgcugccuacggagguggcagccaucuccuucucggcaucaagcuuaccaugaaaaaaaggagaggagcggauacaucaguaggaauuguaggauuacuguuaacuacugcaauggcagcagaaguuacaagaagaggaagugccuauuauauguauuuggacagaaacgacgcaggagaagcaauaucauuuccaacaacauuaggaaugaauaaauguuauauacaaauaauggauuuaggacauaugugugaugccacaaugucuuaugaauguccuauguuagacgaaggaguagaaccugaugacguugauuguuggugcaacacaacaaguacuuggguaguauauggaacaugccaucacaaaaaaggggaagcaaggagaucaagaagggcaguuacauuaccaucucacucuacgagaaaauuacagacaagaucacaaacgugguuagaaaguagagaauauacaaaacacuugauacgagucgaaaauuggaucuuccggaauccagguuuugcgcuagcagcagcagcaauagcauggcuauuaggaaguucaacaagucaaaaaguaauauacuuagugaugauuuuguuaauugcaccugcguacaguauaagauguauaggagugucuaauagagacuuuguagaaggaaugucaggcggaacauggguagauauuguacuagaacacggaggaugcgugacaguaauggcacaagacaaacccacaguagauauagaauuaguaaccacaacaguaagcaauauggcagaaguaagaagcuauuguuaugaggcaaguauaucagauauggcaagugauucaagauguccaacucagggagaagcuuauuuagauaaacaaagcgacacacaauauguauguaaaagaacacuuguagacagaggauggggaaacgggugcgguuuauuuggaaaagguucauuaguaaccugugcaaaauuugcaugcucuaaaaaaaugacuggaaaaaguauacaacccgaaaauuuagaauauagaauaaugcuaaguguacacggaucacaacauucagggaugauaguaaaugauacgggacaugaaacagaugaaaauagagcaaaaguagaaauaacucccaacaguccaagagcagaagcgacacuagguggguuugguaguuuagggcuggacugcgaaccaagaacggguuuagacuuuucagauuuguauuaucuaacuaugaacaauaaacauugguuaguacauaaagagugguuucacgacauuccgcuuccauggcaugccggugcagacacaggaacaccacauuggaacaauaaagaagcauuaguagaauuuaaagaugcacaugcaaaaagacagaccguaguagucuuaggaagucaagaaggagcgguacacacugcacuagcaggagcacuagaagcagaaauggacggagcaaaaggaagacugucaaguggacaccuaaaauguagguuaaaaauggauaaacuaagauuaaaagguguuucauauucacuauguacagcagcauuuacauuuacgaaaauaccagcagaaacauuacacgguacaguaacaguagaaguacaguaugcaggaacagauggaccuugcaaaguaccugcacagauggcuguagauaugcaaacacuuacaccaguaggcagacuaauaacagcaaauccaguaauuaccgaaaguaccgaaaauucaaaaaugauguuagaacuugauccaccuuuuggagacagcuauauaguaauaggggugggagaaaaaaaaauaacacaccauuggcauagaaguggaaguaccauagggaaagcauuugaagcaacaguuaggggagcaaaaagaauggcgguauuaggggacacagcuugggacuuuggaaguguugguggagcauuaaauucauuaggaaaaggaauacaucaaauauuuggagcagcauuuaaaucauuauuuggagggaugaguugguuuagucaaauauuaauaggaacacuauuaaugugguuaggguuaaauacuaaaaauggcaguauaagcuuaauguguuuagcacuagggggagugcuaauauuucuaaguacagccguaagugcagacgucggaugcaguguugauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6913 - RNA, 2497 nt, Artificial Sequence
  ZIKV prME variant mRNA Design 2 opt
ggggcgcugccuacggagguggcagccaucuccuucucggcaucaagcuuaccaugaaaagaagaggugcagacacgaguguuggaauagugggauuguuacuaacaacagcaauggcugcagagguuaccagaagaggaucugcauauuauauguauuuagacagaaacgaugccggugaagcaauaaguuucccaacgacucuaggaaugaauaaaugcuacauacaaauuauggacuuaggacauaugugcgaugcaacaaugagcuaugaaugcccaauguuagaugagggaguagaaccagacgauguagauuguugguguaauacaacaucaacuuggguaguuuacgguacuugccaucauaaaaaaggagaagcaagaagaucaagaagagcaguaacauugccuagucauucaacacgcaaacuccaaacaagaucacaaacaugguuggaaucaagagaauacacaaaacauuuaauaagaguagaaaauuggaucuuucgaaauccaggauuugcacuagcagcagcagcaauagcaugguuauuaggaaguucuacaucacaaaaaguaauauaccuagucaugauacucuugauagccccugcauauucuauaagaugcauaggaguuaguaauagagauuucguugaaggaauguccggaggaacuuggguugauauagucuuagaacacggaggauguguaacuguaauggcacaagauaaaccaacuguagauauagaauuaguuacaacaacaguaucuaauauggcagagguacgaucauacuguuaugaggccaguauaagugauauggcauccgacucacgauguccaacacaaggagaagcuuaccuugauaaacaaagugauacgcaauauguauguaaaagaacauuaguagaucgaggauggggcaauggcugcggauuauuuggcaaaggauccuuaguaacaugugcaaaauucgcauguagcaaaaaaaugacaggaaaaucaauacaaccagaaaauuuagaauauagaauaaugcuaucaguacauggaucacaacauagcggaaugauaguuaacgauaccggacaugaaaccgacgaaaauagagcaaaaguagaaauaacaccaaacagcccaagggcagaagcaacauuaggcggauuuggauccuuagguuuagacugugaaccacgcacugguuuggauuuuagugauuuauacuaccuuacaaugaacaauaaacauugguuaguccacaaagaaugguuucaugauauaccauuaccauggcaugcuggugcagauacugggaccccacauuggaauaauaaagaagcauuaguagaguuuaaagaugcacaugcaaaaagacaaacagucgucguccuagggagucaagaaggagcaguacacacagcacuagcaggagcccuugaagcagaaauggacggagcaaaaggaagauuaaguucaggacauuuaaagugucgccuuaaaauggacaaauuaagacuaaaaggagucaguuauucgcuauguaccgcagcguucacguuuacaaaaauuccggcagaaacucuacaugguacuguuacuguagagguccaauaugcaggcacagacggaccauguaaaguaccagcucaaauggccgucgacaugcaaacacucacuccaguaggaagauuaauaacagcaaauccaguaauuacagaaucaacagaaaauaguaaaaugauguuagaauuggauccacccuuuggagacaguuauauuguaauaggagucggagaaaaaaaaauaacacaucauuggcaucgaucaggaucaacgauaggaaaagcauuugaggcaaccgucagaggagcuaaaagaauggcaguucuaggagacaccgcaugggauuucggaucagucggaggggcacuaaauucucucgguaaagggauacaucaaauauuuggagccgcauuuaaauccuuauucggagguaugaguugguuuucacaaauccuaauaggaacauugcuaauguggcugggacuaaauacgaaaaaugguaguauaucauugaugugcuuagcucuaggagguguauuaaucuuucuuagcacagcaguuucggcagacgucggauguaguguagauuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6914 - RNA, 2494 nt, Artificial Sequence
  ZIKV prME variant mRNA Design 2 opt
ggggcgcugccuacggagguggcagccaucuccuucucggcaucaagcuuaccaugagaagaggagccgacacuucagugggaauuguaggauuauuauuaacaaccgcaauggcagcagaaguuacaagaaggggaucagcauauuauauguaucuugauagaaaugacgcaggugaagccauuaguuuccccacaaccuuagguaugaauaaaugcuauauacaaauaauggauuuaggacauaugugugaugcaaccaugaguuacgaaugcccaauguuagacgaagggguugaacccgaugauguagauugcugguguaacacuacaaguacauggguaguauauggcacaugucaucacaaaaaaggugaagcaagaagaucaagacgagcaguuaccuuaccuagccauaguacacgcaaauuacaaacaagaucacagacuugguuagaaaguagggaauauaccaaacacuuaauaagaguugaaaauuggauauuuagaaaucccggauuugcauuagcagcagcagcaauagcgugguuacuaggcagcucaacuagucaaaaaguaauauaucuaguaaugaucuuauuaauagcuccagcauauucaauaagauguauaggagugagcaauagagauuuuguagaaggaaugaguggagguacauggguagacauaguacuagaacacggaggcuguguaacagucauggcacaagauaaaccaacaguugauaucgaauugguaacaacaacaguaagcaacauggcggaaguaagaagcuacugcuaugaagcuaguauaagcgacauggcaagugauucaagauguccuacacaaggagaagcguaucuagauaaacaaagugauacacaauauguuuguaaaagaacauuaguagauagaggauggggaaauggauguggauuguuugguaaagggucauuggucacuugcgcuaaauuugcauguaguaaaaaaaugacaggaaaaagcauucaaccagaaaaccuagaauauagaauaaugcuuaguguccauggaucacagcauucagguaugauaguaaaugacacaggacaugaaacagacgaaaauagagcaaaaguagaaauaacaccgaacagcccaagagcagaagcuacuuuaggaggauuuggaaguuuaggacuagacugugaaccaagaacaggcuuagauuuuagugacuuauauuauuugacgaugaauaauaaacacugguuaguacacaaagaaugguuccaugauauaccauugccauggcaugcaggugcagauacaggaacaccacacuggaauaacaaagaggcccugguagaguucaaagaugcacaugcaaaaaggcaaacaguuguaguauuaggaucucaagaaggugcaguucacacugcccuagccggagcauuagaagccgaaauggauggagcuaaaggaagauugaguagcggacaucuuaaaugcagauuaaaaauggauaaauuaagacucaaagguguaagcuauaguuuauguacagcagccuuuacauuuacuaaaauacccgcagaaacacuacauggaacaguuacaguugaaguacaauacgcaggaacggaugguccauguaaaguaccugcucaaauggcaguagacaugcagacacuaacgccgguagguagauuaauaacagcgaaucccguuauaacugaaucaacagaaaauucaaaaaugaugcuagaauuagauccaccuuuuggagacagcuauauaguaauaggaguaggagaaaaaaaaauaacacaucacuggcauagaucaggcagcacaauugguaaagcuuuugaagcuacaguucgaggagcaaaaagaauggcaguacuaggagauacagccugggauuuuggaagcguagguggagcuuuaaacucuuugggaaaagguauacaucaaauuuuuggagcugcuuuuaagaguuuguuugguggaaugucgugguuuagucaaauauugauaggcacauuacucaugugguuaggacuaaauacaaaaaacggaucaauaagucuaauguguuuagcacuaggaggaguauuaauauuuuuaucuacagcaguaagcgcagacguuggauguucaguagauuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6915 - RNA, 2491 nt, Artificial Sequence
  ZIKV prME variant mRNA Design 2 opt
ggggcgcugccuacggagguggcagccaucuccuucucggcaucaagcuuaccaugaggggagcagauacaucaguaggaauaguaggauuauuauuaacaacagcaauggcagcagaaguuacaaggaggggaagugccuacuacauguacuuagauagaaacgaugcaggagaagcaauuaguuuuccuacaacauuaggaaugaauaaaugcuauauacaaauaauggacuuaggucauaugugcgacgcaacuaugucuuacgaaugcccaauguuagaugaaggaguagaaccagacgauguagacuguugguguaauaccacaaguacguggguaguauauggaacuugucaucacaagaaaggagaagcaagaagauccaggagagcaguaacuuuaccaucacacucaacgagaaaauuacagacaagaagccaaacaugguuagaaucaagagaauauacaaaacacuuaaucagaguagaaaauuggauauuucgaaauccaggauucgcacuugcggcagcugcuauagcauggcucuuaggaaguucuaccagccaaaaaguaauuuauuuaguaaugauacuuuuaauagcacccgcauauucaauaagguguaucggaguuucuaauagagauuuuguggaaggaaugucaggcggaacuuggguggacaucguuuuagaacacggaggauguguuacaguaauggcucaagauaaaccaacuguagauauagaauuaguaacuacgacagugucaaauauggcagaaguaagaucuuauuguuaugaggcuucaaucagugacauggcaucagauaguagauguccaacacaaggagaagcauauuuagacaaacaaagugacacacaauaugucuguaaaaggacauuaguagacagaggguggggaaauggauguggacucuuuggaaaaggaucucuaguaacuugcgcuaaauuugcauguucaaagaaaaugacaggaaaaucaauacaaccagaaaaucucgaauauagaauuauguuaucaguacauggcucacaacauaguggaaugauaguuaaugauacaggacaugaaacagaugaaaacagagcaaaaguagaaauuacaccuaacucaccuagagccgaagccacacuaggugguuuuggaaguuuaggacuagauugugaaccaaggacaggucuagauuuuagcgacuuauauuauuuaacaaugaauaauaaacauugguugguccauaaagaaugguuccacgauauuccauuaccuuggcaugcaggagcagauacaggaacaccacauuggaauaacaaagaagcauuaguugaauuuaaagaugcacaugcuaaaagacaaacuguaguuguacuuggaucccaagaaggagcaguucauacagcauuagcgggugcacuugaagcagaaauggauggagcaaaagguagacuaucaagcggacaucugaaaugucgacuaaaaauggauaaacugagauugaaaggaguuaguuauaguuuaugcacagcagcauucacauuuacaaaaaucccagcagaaacauuacauggaacaguaacuguagaaguacaauaugccggaacugauggacccuguaaaguucccgcacagauggcgguagacaugcagacauuaacuccaguagguagauuaauaacggcaaauccugucauaacggaaucuacagaaaauucaaaaaugauguuggaauuagacccaccauuuggagauuccuacauaguuauaggagucggugaaaagaaaauaacacaucauuggcacaggagcggaaguaccauugguaaggcuuuugaagcaacaguaagaggagcaaaaagaauggcaguuuugggagauacagcaugggauuucgguaguguuggaggagcucuuaauucuuuaggcaaaggaauacaucaaauauucggagcagcuuuuaaaagucuauucggagggaugaguugguuuagccaaauacuaauuggaacgcuacugaugugguuaggacucaacacuaaaaacgggagcauuaguuuaaugugccuagcauuagguggaguacuaauauuucuaucaacagcaguuucagccgaugucggcuguucaguagauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6916 - RNA, 2488 nt, Artificial Sequence
  ZIKV prME variant mRNA Design 2 opt
ggggcgcugccuacggagguggcagccaucuccuucucggcaucaagcuuaccaugggugcagauacaucaguuggaauaguaggacugcuauuaacaacagcaauggcggcagaaguaacaagacggggaucagcuuauuacauguaucuagauagaaaugaugcaggagaagcaauaucauucccaacgacacuaggaaugaacaaauguuacauccaaauaauggaccuaggacauaugugcgacgccacuaugagcuaugaaugcccaaugcuagaugaaggaguagaaccggaugauguugacuguugguguaauacgacaucaacuuggguaguauacggaacuugucaucauaagaaaggagaagcaagacgaaguagacgagcaguaacacuaccaucacacaguacaagaaaauuacaaacaagaagucagacauggcuugaaagcagagaauauacaaaacauuuaauaagaguagaaaauuggauuuuuagaaauccagguuucgccuuagcugcagcugcgauagcauggcucuugggaucuagcacuucacaaaaaguaauauacuuaguaaugauuuuacuaauugcaccagcauauucaaucagauguauuggagucagcaauagggacuuuguagaaggcaugucagguggaacguggguagauaucguacuagaacacggagggugcguaacaguaauggcacaggauaaaccaacgguagacauagaauuaguaacgacaacgguaucaaauauggcagaaguaagaaguuacuguuacgaggcaucuauuagugacauggcuucagacucacgauguccaacacaaggagaagcauauuuagauaaacaaagugauacgcaauacguaugcaaaagaacauuaguagacagagggugggguaauggaugcgguuuauuuggaaaaggaucauuaguaacaugugcaaaauuugcauguucuaagaaaaugacaggaaaaaguauccaaccagagaauuuagaauacaggauuauguuaaguguacacggaucacaacauucagggaugauaguaaaugacacaggacaugaaacugaugaaaaucgagcaaaaguagaaauaacucccaauucaccaagagcugaagcuacauuagggggauuuggaucacuaggacuagauugugaaccgagaacaggauuagauuuuagugauuuauauuauuuaacaaugaacaauaaacacugguuaguacauaaagaaugguuucaugacauaccauuaccguggcacgcaggggcagauacuggaacaccacauuggaauaauaaagaggcacugguugaguucaaagacgcucacgcaaaaagacaaacaguagucguguuaggcucucaggaaggagcaguacauaccgcguuagcaggcgcacuagaagcagaaauggauggcgcuaaaggcagacuuagcagcggacacuugaaaugcagacuaaaaauggacaaauuacgguuaaaaggcgugaguuauucauuauguacagccgcauucacauucacaaaaauaccugcugaaacuuuacaugggacagugacgguagaaguacaguaugcggggacagacggaccuuguaaaguaccugcacaaauggcaguagauaugcaaacuuuaacaccaguaggaagauuaauaacagcaaauccaguaauuacagaaaguacagaaaauaguaaaaugaugcuagaauuagacccaccuuuuggcgacucauauauagucauaggaguaggugaaaagaaaauaacacaccauuggcacaggaguggaucuacaauaggaaaagcauuugaagccacaguaagaggagccaaaagaauggcaguacuaggagacacagcuugggauuuuggaagcgucggaggagcacuaaauaguuuaggaaaaggaauacaucaaauauucggagcagccuucaaaucauuauuuggugguauguccugguuuagucaaauauuaauaggaacauuauuaaugugguuaggacuaaauacuaaaaacgguaguaucucacuuauguguuuagcccuggguggaguauuaauauuuuuaucaaccgcuguaucagcugauguuggauguucaguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6917 - RNA, 2485 nt, Artificial Sequence
  ZIKV prME variant mRNA Design 2 opt
ggggcgcugccuacggagguggcagccaucuccuucucggcaucaagcuuaccauggcagauacauccguaggaauaguaggacuuuuauuaacaacagcaauggcagcggaaguaacaagaagagguucagccuauuacauguauuuggauaggaaugacgcaggagaagcaauuagcuucccuacaacacuugggaugaacaaauguuauauacaaaucauggaccuaggacauaugugugaugcaacuaugaguuacgaauguccaaugcuugaugagggaguagaaccagacgacgucgauuguuggugcaauacuacaaguacuuggguaguauaugguacaugucaucauaaaaaaggagaagcaagacgcucaaggagagcaguaacauuaccuagucacucaacaagaaaacugcaaacacgaagucaaacauggcucgagagccgagaauauacaaaacaucuaauuagaguagagaacuggauauucagaaauccaggauucgccuuagcggcagcagcaauagcaugguuacuaggaaguucaacaucacaaaaaguaauauaucuagucaugauuuuauuaauagcuccugcauauucuauacgauguauaggagucaguaauagggauuuuguagaaggaaugaguggagguaccuggguagauauuguauuagaacacggaggcuguguaacuguuauggcacaagauaaaccuacaguagauauagaacuaguaacgacaacagugagcaacauggcugaagugagaucauauuguuaugaagcuagcauaagcgauauggccagugauucuagauguccaacccaaggagaagcauacuuagauaagcaaucugauacccaauauguaugcaaaagaacacuaguagaccgaggauggggcaauggaugcggucuauucggaaaaggaagcuuagugacaugugcaaaauuugcauguuccaaaaaaaugacaggcaaaagcauacaaccagaaaauuuagaauacaggauaaugcuaucaguacauggaucucaacauagcggaaugauaguaaaugauacaggacacgaaacugacgaaaauagagccaaaguagagaucacacccaacaguccaagagcagaagcaacgcuaggaggauuuggaagccucggauuagauugugaaccaagaacaggacuagauuucagcgaucuuuacuauuuaaccaugaacaacaaacauugguuaguacauaaagagugguuucaugauauaccguuaccuuggcaugcaggagcagauacaggaacaccacacuggaauaauaaagaagcccuuguagaauuuaaagacgcacaugcaaaaagacaaacgguaguuguauuagguagucaagaaggagcaguacauacagcacuagcuggugcauuagaagcagaaauggacggagcaaaaggaagauuaagcagcggacaucuaaagugcagacuaaaaauggauaaacuucgccuaaaaggaguaucauacucauuauguacugccgcuuuuacauucaccaaaauaccugcugaaacuuuacacggaacagucacuguagaaguacaauaugcagguacagaugguccauguaaagugcccgcucaaauggcaguagauaugcaaacacuaacaccuguaggaagauuaauaacagcaaacccuguaauaacagaaucaacagaaaacucgaaaaugaugcucgaacuagacccaccguuuggagauaguuacauuguaauugguguaggagaaaaaaaaauuacacaucauuggcaccguucagggaguacuauaggaaaagcauuugaagcaacuguaagaggagcaaaaagaauggcaguauuaggugauacagccugggacuucgguaguguaggaggagcauugaacucccuaggaaaaggcauucaucaaauauuuggagcagcauuuaaaaguuuauuuggaggaaugucaugguuuagucaaauauuaauaggcacgcuacuuaugugguuaggacuaaauacaaaaaacggaaguauuagccuaaugugcuuagcuuuagggggcguguuaauuuuuuugagcacagcaguuagcgcagacguaggauguaguguugauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6918 - RNA, 2482 nt, Artificial Sequence
  ZIKV prME variant mRNA Design 2 opt
ggggcgcugccuacggagguggcagccaucuccuucucggcaucaagcuuaccauggacacuaguguaggaauaguaggucuacuacuaacaacagcaauggcagcagaaguuacucgaagagguagcgcauauuauauguauuuagauagaaaugacgcaggagaagcuauaaguuucccaacaacacuaggaaugaacaaauguuacauucaaauaauggaccugggacauaugugcgaugcaaccaugucuuacgaauguccuaugcuugacgaaggaguagaaccugaugauguugacuguugguguaauacaaccagcacuuggguaguauauggaacaugucaucauaaaaaaggggaagcaagacgaucaagaagggcagugacauugccaagucacucaacuagaaaauuacaaacuagaucacaaacaugguuggaaucaagagaauacacaaaacauuuaauuagaguggaaaauuggauauuccgaaacccaggauucgcauuagcggcagcagcaauagcuugguuauugggaagcucaacgagucaaaagguuauauaccuagugaugauacuauuaauagcuccagcauauuccauaagaugcauaggaguaaguaaccgagacuuuguagaaggaaugaguggaggaacauggguagauauaguauuggaacauggaggauguguaacaguaauggcacaagauaaaccaacaguagauauagaacuaguuacaacaacaguuucaaauauggccgaaguaagaucguacuguuaugaggcuagcauaucagacauggcaucugauucaagauguccaacucaaggcgaagcauacuuagauaaacagagugacacgcaauauguaugcaaaagaacacucguggauagaggaugggguaacggguguggccuguucggcaaagguagucuaguaacaugugcuaaauuugcuuguucaaaaaaaaugacaggaaaaucaauacaaccggaaaaccuagaauacagaauaauguuaaguguccacgggagucaacauucaggaaugauuguuaaugauacaggucaugagacugaugaaaauagagcaaaaguagagaucacaccaaauucaccacgagcagaagcaacacuaggugguuuuggaaguuuaggauuagauugugaaccaagaacaggauuagauuuuucagacuuguauuacuuaacaaugaauaauaaacacugguuaguccacaaagaaugguuucaugauauuccacugccauggcaugcaggagcagauacaggcacaccacacuggaauaacaaagaagcauuaguugaauuuaaagaugcacacgcuaaaagacaaacaguagucguauuaggaagucaagaaggagccguucacacagcacuagcaggugcauuagaagcugaaauggacggagcuaaagguagauuaucaaguggacaccuaaaaugcagacugaaaauggacaaauuaagacuaaaaggaguaaguuauagcuuauguacagcggcauuuacauuuacaaaaauaccggcagaaacauuacaugguacaguaacuguagaaguacaauacgccggaacagauggaccaugcaaaguaccugcucaaauggccgucgauaugcaaacccuaacaccgguuggaagacucauaacagcaaauccaguaauaacagagucaacagaaaauaguaaaaugauguuagaauuagacccaccauuuggugacucguacauagugauaggaguuggugaaaaaaaaauaacacaccauuggcacagaaguggaagcacuauuggaaaagcauuugaagcaacuguuagaggcgcaaaaagaauggcaguucuuggagauacagcaugggauuuuggaaguguuggaggagcauuaaacaguuuaggaaaaggcauacaucaaauuuuuggagcagcuuuuaaaucacuauuuggaggaaugucaugguuuucacaaauauuaauugguacuuuacuaaugugguuaggacuaaauacuaaaaaugguaguauaaguuuaaugugucuagcauuaggcggagucuuaaucuucuuaucaacagcaguaagcgcagacguaggguguaguguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6919 - RNA, 2479 nt, Artificial Sequence
  ZIKV prME variant mRNA Design 2 opt
ggggcgcugccuacggagguggcagccaucuccuucucggcaucaagcuuaccaugaccagcguuggaauaguagguuuacuauuaacaaccgcaauggcagcagaagugacaagaagaggaagugcauacuauauguacuuagaucguaacgaugcaggugaagcuauaucuuuuccaacaacguuaggaaugaauaaauguuacauacaaauaauggacuuaggacauaugugugacgcaacuaugucauaugaauguccaauguuagaugaaggaguugaaccagacgacguagauuguugguguaauacuaccaguacauggguaguauauggaacaugccaucauaaaaaaggagaggcuagaagaaguaggagagcaguaacauuaccaucucauucaacaagaaaacuucaaacacgaucacaaaccuggcuagaaagccgagaauacacaaaacaucuaauacgaguggaaaauuggauauuuagaaauccaggauucgcacuagcugcagccgcuaucgcauggcuacuagguaguucaacaucacaaaaaguaauuuacuuaguaaugauccuacucauugccccggcauauucaauaagaugcaucgggguuagcaacagagacuuuguugaaggcaugucgggaggcacauggguagauauuguacuugagcacggagggugcguaacuguuauggcucaagauaaaccaacaguugacauagaacuaguaacaacaacaguaucaaacauggcggaaguaagaaguuauugcuaugaagcaagcauaucugacauggcaucagauucuagauguccaacacaaggagaagcuuauuuagauaaacaaucagacacacaauacguauguaaaagaacauuaguagacagaggcuggggaaauggauguggauuguuuggaaaaggaucauugguaacaugugccaaauucgcauguaguaaaaaaaugacuggaaaaaguauccaaccagaaaauuuagaauaucgaauuauguuaagcguccaugguucccaacauucagguaugauaguaaacgauacaggacacgagacugaugaaaauagagcaaaaguggaaauaacuccaaauaguccaagagcagaagcaacuuuaggugguuuuggaucccucggauuggauugugaaccaagaaccggauuagacuucagugaucuauacuacuuaacaaugaauaauaaacacuggcuuguccacaaagaaugguuccacgacaucccauuaccauggcacgcaggcgcagauacaggcaccccacauuggaauaauaaagaagcacuaguagaauucaaagacgcacaugcaaaaagacaaacgguaguaguauuaggaagucaagaaggagcuguacauacagcccuagcuggagcacuagaagcagaaauggacggagcaaaagguagauuaaguaguggacaccugaaaugcagauuaaaaauggauaaacuaagguuaaaaggaguuagcuauucuuuauguacugcagcauuuacauucacuaaaauaccagcagaaaccuuacauggaacagugacaguagaaguacaauaugcaggaacugauggaccauguaaaguaccagcacaaauggcaguugauaugcaaacauuaacuccaguagggagacuuauaacagcaaauccaguaauaaccgaaucaacagaaaauagcaaaaugauguuagaauuagacccaccuuucggcgacagcuacauagucauaggaguuggugaaaaaaaaauaacccaucauuggcauagaaguggaagcacaauaggcaaagcauuugaagcaacugucagaggggccaaaagaauggcaguucuaggagauaccgcaugggacuucggaaguguaggaggagcacuaaacaguuuaggaaaaggaauacaucagauauuuggggcagcauucaaaagucuauuugggggcaugagcugguuuucacaaauuuuaauuggaacauuguuaauguggcuaggauuaaauacaaaaaaugguagcauaagcuuaaugugucuagcucuaggaggaguacugauuuuuuuaagcacagcuguuagugcugauguaggguguucuguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6920 - RNA, 2479 nt, Artificial Sequence
  ZIKV prME variant mRNA Design 2 opt
ggggcgcugccuacggagguggcagccaucuccuucucggcaucaagcuuaccaugacaaguguugguauagugggguuauuauuaacgacugcaauggcagcagcaguaacaagaagaggaucagcuuauuauauguauuuagacagaaaugaugcaggggaagcaaucucauuucccaccacucuagguaugaauaaauguuauauucaaauaauggaucucggucauaugugugaugcuacuaugaguuaugaauguccaauguuagaugaaggaguugaaccagaugaugucgacuguuggugcaauacaacaaguacuuggguaguauauggaaccugucaucauaagaaaggagaagcuagacguaguaggagagcaguaacacuuccaagucauucaacaagaaaacuacaaacuagaagccaaacaugguuagaaaguagagaauauacaaaacaccuaauaagaguagaaaacuggauuuuuagaaacccaggauuugcccuggcagcugcugcuauagccugguuacugggauccaguacaucacaaaaaguaauauacuuaguaaugauauuauugauagcucccgcuuauagcauaagauguauuggcgucucuaauagagauuucguagaagggaugaguggugggacauggguagauauaguauuagaacacggagguugcguaacaguaauggcacaagacaaaccaacaguagauauagaauuagugacaacaacagugagcaauauggcugaaguacgaucauauugcuaugaagcaucaaucucagauauggcuucagacucaagauguccaacgcaaggagaagcauaucuagacaaacaaagugauacacaauacguauguaaaagaacauuaguagauagagguugggguaaugguuguggacuauuuggaaaaggcuccuuaguuacaugugcuaaauucgcuugcuccaagaaaaugacaggaaaaucaauacaaccugaaaaucuugaauacagaauaaugcuaaguguacauggaagccaacauagugggaugauaguaaaugauacgggacaugaaacugaugaaaauagagcaaaaguagaaauaacuccaaauagcccaagagcagaagcaacuuuaggcggauucggcagccuuggauuagauugugaaccaagaacaggcuuagauuuuagcgacuuauauuacuuaacaaugaauaacaaacauugguuaguccauaaagaaugguuucacgauauaccauuaccauggcaugcgggugcugauaccgguacaccacauuggaauaacaaagaagcauugguagaguucaaagacgcacacgcaaaaaggcaaacagucguagucuugggaagccaagaaggagccguacauaccgcauuagcaggagcacuagaagcagaaauggacggagcaaaaggaagauuaagcaguggacauuuaaaaugucgauuaaaaauggauaaacuuagauuaaaaggagucucauauucacuuuguacagcagcauuuacuuuuacaaaaauaccugcagaaacauuacaugggacagugacaguggaaguacaauaugcaggaacagauggaccauguaaaguaccagcucaaauggcuguugauaugcaaacacuaacaccaguaggacgacuaauaacugcuaauccaguaauaacagaaucaacugaaaauagcaaaaugaugcuagaacuugacccgccuuuuggugacaguuauauaguuauaggugucggugaaaagaaaaucacacaucacuggcauaggagugggucaacaauagggaaagcguuugaagcaacagucaggggugcaaaaagaauggcuguacuaggagauacagcaugggauuuuggaaguguaggaggggcauugaauagucuaggaaaagguauacaucaaauauuuggggcagcauuuaaaagucuauuuggcggaaugucaugguuuucacaaauucuaauaggaacuuuacuuauguggcucggauugaauacgaaaaauggaucaaucagcuuaauguguuuagcuuuaggaggugugcuaauauuuuuaaguacagccguaucagccgauguaggauguucuguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6921 - RNA, 2491 nt, Artificial Sequence
  ZIKV prME variant mRNA Design 2 opt
ggggcgcugccuacggagguggcagccaucuccuucucggcaucaagcuuaccaugagaggagcagauacaaguguugggauaguaggacugcuucuaacuacugcaauggccgcugcgguaacgagacgaggaagugcauauuacauguauuuagacagaaacgaugcaggagaagcuauaaguuuuccaacaacgcuagguaugaacaaaugcuacauacagauaauggaucuaggacacaugugugacgcaacuaugucauacgaaugcccaauguuagaugaagguguagaaccagaugaugucgacuguuggugcaacacaacuucgacauggguaguauauggaacaugucaucauaaaaaaggagaagcacgccgaucaagaagggcagucacauuaccaucacacaguacaaggaaauuacaaacaagaagucaaacauggcuugaaucaagagaauauacaaaacacuuaauuaggguagaaaauuggauuuucagaaauccaggauuugcauuagcagccgcagcaauagcuugguuauuaggaaguaguacaagccaaaaaguaauuuauuuaguuaugauacuuuuaauagcuccagcauauucaauacgauguauagguguaucaaacagagauuuuguugaaggaaugaguggaggaacauggguagauauaguucuagaacauggagguuguguaacaguaauggcacaggacaaaccaacaguagacauagaauuaguaacaacaacaguuucaaauauggcagaaguaagaucuuauuguuacgaagcaaguauaagcgauauggcuagcgauucacgaugucccacacaaggagaagcuuaucuagauaaacaaucagauacacaauacguauguaaacgaacauugguagacagaggauggggaaauggauguggauuauuuggaaaagguagccuaguaacaugcgcaaaauucgccuguaguaaaaaaaugacaggaaaaucaauucaaccagaaaacuuagaauauagaauaaugcuauccguucacggcucgcaacauucagggaugauuguaaaugauacaggacaugaaacagaugaaaacagggcuaagguagaaauaacucccaauucaccaagagcugaagcaacauuaggcggguuuggaucacucggucuagacugugaaccacgaacuggauuagauuuuucagaucucuacuaucugacuaugaauaauaaacauugguuaguccauaaagaaugguuucacgauauaccacuacccuggcaugcaggugcagauacuggaacaccucacuggaauaauaaagaagcucuuguagaguuuaaagaugcacaugcaaaaagacaaacaguaguaguauuaggaagucaagaaggagcaguacacacagcauuagccggugcucuagaagcagaaauggacggagcaaaaggcagacucucaaguggacauuuaaaaugucgauuaaaaauggacaaauuaagguuaaaagguguaaguuacagucuauguacagcugcauuuacauuuacaaaaauaccugcugaaacgcuccauggaacagucacaguugaaguccaauaugccggaaccgauggcccauguaaagucccugcacaaauggcgguagacaugcaaacauuaacaccaguugguagauuaauaaccgcaaauccgguuauaacagaaaguacagaaaauuccaaaaugauguuagaauuagauccaccauuuggagacuccuauauaguaauuggaguaggagaaaaaaaaauaacacaucauuggcacagaucagguucaacaauaggaaaagcguucgaagcgacagugagaggagcaaaaagaauggcuguauuaggagauacagcuugggacuuuggguccguaggcggugcacuuaauucacuuggaaaaggcauacaucaaauuuucggggcggcuuuuaaaucacuuuucggaggaaugucaugguuuucacagauauuaauaggaacauuauuaaugugguuaggacuuaauacaaaaaauggaagcauuaguuuaaugugccuagcgcugggagguguacuuauauuucuuucaaccgcaguaagugcugauguaggguguucuguagacuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6922 - RNA, 2515 nt, Artificial Sequence
  ZIKV prME variant mRNA Design 2 opt
ggggcgcugccuacggagguggcagccaucuccuucucggcaucaagcuuaccaugagaggacugucaucgagaaaaagaagaagccaugauguccuaacaguucaauuucuaauauuagggauguuacuaaugacgggaggaguaacuagacguggaucagcauauuauauguaccuagauagaaacgaugcuggugaagcaauaucauuuccaacaaccuuaggaaugaauaaauguuacauucaaauuauggauuugggucauaugugcgaugcaaccauguccuaugaauguccaauguuagacgaaggaguggaaccagaugauguagauuguuggugcaauacaacgucaacuuggguaguauauggaacuugucaucauaagaaaggagaagcaagaagaucuagacgagcaguaacauuaccaucacauucaacuagaaaacuacaaacaagaagccaaacaugguuagagaguagagaauacaccaaacaucuaauaaggguugaaaauuggauauuucguaauccugguuucgcauuagcagcagcagcuauagcaugguuauuaggaagcaguacaucacaaaaaguaauauacuuagucaugauauuacuaaucgcaccagccuauucaauaagauguauaggaguuaguaauagagauuuuguggaagguaugagugguggaacauggguugacaucguacuagaacauggaggguguguuacuguaauggcacaagauaaaccgacaguugauaucgaauuagugacaacaacaguaucuaauauggcagaaguaagaagcuauuguuaugaagcuagcauauccgauauggcaucagacagcagaugucccacacagggagaagcauaucuugauaaacagucagacacacaguauguaugcaaaagaacauuaguagacagaggguggggaaacggaugugguuuauuuggaaaaggaucauuaguaaccugugcuaaauuugcaugcagcaagaaaaugacuggcaaaaguauacaaccggaaaaucuagaauaccgaauaaugcucaguguucacggaucacaacauucagguaugauuguaaacgauacuggacaugaaacagaugaaaacagagcaaaagucgaaauaacuccaaacaguccacgagcagaagcuacuuuaggcgguuuuggaucccuuggauuagauugugagccacgaacuggauuagauuucagugauuuauauuauuuaacaaugaauaauaaacacugguuaguacacaaagaaugguuccaugauauaccauuaccuuggcaugcaggagcugauacagggacaccacacuggaauaacaaagaagcccuaguagaauuuaaagaugcacaugcgaaacgacaaacaguuguugucuuaggaucucaagaaggugcaguacauacagcauuagcaggagcccuagaagcagaaauggacggugcuaaagggcgauuaucuagcggacauuuaaaauguagauuaaaaauggauaaauuaagacuaaaagguguuagcuauaguuuauguacagccgcauucacauucacuaaaauaccugcagagacucuacauggaacaguaacuguagaaguacaauaugcagguacugacggaccuugcaaaguuccagcacaaauggcaguugacaugcaaacacuaacuccaguaggaagauuaauaacggcgaacccaguuauaacagaaucaacugaaaauagcaaaaugaugcuugaacuagauccaccauuuggagacucauauauaguaauaggaguaggcgaaaagaaaauaacacaucacuggcauagaagugguagcacuauugguaaagcauuugaagcaacuguaagaggugcaaaaagaauggcaguauugggagauacugcaugggauuuuggaucaguaggcggggcacuaaauucacuugggaaaggaauacaucaaauauuuggagcagcauuuaaaucuuuauuuggaggcaugucaugguucucacaaauauugauuggaacccuacuuauguggcuagguuuaaacacuaaaaauggaucaauuucauugaugugcuuagcauugggaggaguauuaauauucuuaagcacagcaguaagugcagacguaggaugcaguguugacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6923 - RNA, 2515 nt, Artificial Sequence
  ZIKV prME variant mRNA Design 2 opt
ggggcgcugccuacggagguggcagccaucuccuucucggcaucaagcuuaccaugagaggauuaaguagcagaaaaagaagaagccaugacguguuaacaguacaauuucugauacugggaaugcuacuaaugacuggagcaguaacuagaagaggaagcgcauauuauauguacuuagauagaaaugaugcuggugaagcuauauccuuuccaaccacauugggaaugaauaaauguuauauacaaauuauggacuuaggacauaugugugaugcuacaaugucauaugaguguccuaugcuagaugaaggaguagaaccagaugacguagauuguugguguaauacaacgucaacauggguaguauauggaacuugucaucauaagaaaggagaagcaagaagaucaaggagagcugugacacuaccuucacauagcacaagaaaacuucaaaccagaagccaaacauggcucgaaucaagagaauauacuaaacaucuaauacguguugaaaauuggauauuuagaaacccaggauucgcacuugccgcagcagcaauagcaugguuauuggguucgaguacaucucagaaaguaauauacuuaguaaugauucuauuaaucgcaccagcauauucaauaagaugcauaggagugagcaaccgagauuuuguugaaggcaugaguggaggaacguggguugauauaguucuggaacacggaggauguguuacaguaauggcacaagacaaaccaacaguagacauagaauuggucaccacaacaguaaguaauauggcagaaguaagaagcuacuguuacgaggccaguauuagugauauggcaucagauuccagauguccuacacaaggagaagcauauuuagacaaacaaucagauacacaauauguauguaaaaggacauuaguugacagaggauggggaaauggaugcggauuauuugguaaaggaucauuagugacaugugcuaaauuugcaugcaguaagaaaaugacaggaaaaagcauacaaccggaaaaucuugaguauaggauaauguuaaguguacacggaucacaacauucuggaaugauuguaaaugauacuggacaugaaacagaugaaaaucgagcaaaaguagaaauaacucccaauucaccaagagcugaggcaacacuaggaggauuugggagcuuaggauuagauugugaaccuaggacuggacuugauuuuagugaucuauauuauuuaacgaugaauaauaaacauuggcuaguacauaaagaaugguuucaugacaucccauuaccauggcaugccggggcagauacaggaacaccacacuggaauaacaaagaagcguugguagaauuuaaagaugcacaugcaaaaagacaaacaguuguaguauuaggaagccaagagggagcaguacauacugcacuugcaggagcauuagaagcagaaauggauggugcaaaaggaagacuaucaucagggcauuuaaaauguagacuuaaaauggauaaauuaagacuaaaaggcguaagcuauucauuauguacagcagcauuuacuuucacaaaaauaccagcagaaacauuacauggaacaguaacaguggaaguacaauaugcgggaacagauggaccauguaaaguuccagcacaaauggcaguugauaugcaaacauuaacaccaguuggaagacuaauaacagcaaauccaguaauaacugaauccacagaaaacucaaaaaugaugcuugaacuagauccaccauuuggagauaguuauauagugauuggcguuggggagaagaaaauaacacaucauuggcauagaucaggaucaacaauaggaaaagcauuugaagcaacuguaagaggagcaaaaagaauggcaguucuaggagauacagcaugggauuuuggaagcguuggaggagcgcuaaauagcuuggggaaagggauucaccaaauauuuggagcugcauuuaaaucauuauuuggaggaaugaguugguuuagccaaauacuaauaggaaccuuauugaugugguuaggauuaaauacuaaaaacggaaguauaaguuuaaugugucuagcacuagggggaguuuuaauauuuuuaaguacagcaguaucagccgauguaggcuguaguguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6924 - RNA, 2506 nt, Artificial Sequence
  ZIKV prME variant mRNA Design 2 opt
ggggcgcugccuacggagguggcagccaucuccuucucggcaucaagcuuaccaugagaauuauaaaugcaaggaaagagaaaaaaagaagaggugcagauacaagcguugguauaguaggacuacuauuaacaacugcaauggcggcagaaguaacaagacgugguucagcuuauuacauguauuuagauagaaacgaugcuggagaggcaauaucauuuccuacaacuuuaggaaugaauaaaugcuauauacaaauaauggauuuaggacauaugugugacgcaacaaugaguuaugaaugcccuaugcuagaugaaggaguugaacccgacgauguagauuguuggugcaauacuacaaguacauggguuguauauggaacaugucaucacaaaaaaggagaggcuagaagaucaagaagagcaguaacauuaccuucacacagcacacgaaaacuacaaacaagaucacaaacaugguuagaaucaagagaauacacaaaacaucuaauuaggguagaaaauuggaucuuuagaaauccuggcuuugcacuugcagcagcagcaauagcuugguuauuagguagcaguacaucucaaaaaguaauauauuuaguaaugauacuacuaaucgcaccagcauacagcauaaggugcauaggaguaucuaauagggauuuuguagaaggaaugucaggaggaacauggguugacauuguacuagaacauggugguuguguaacaguaauggcgcaagauaaaccaacagucgauauagaacuaguaacaacaaccguaucaaauauggcugaaguuagaucauauuguuaugaagcaucaaucagcgauauggcaucagacagcagaugcccaacucaaggagaagcuuauuuagauaagcaaucagauacucaauacguauguaaaagaacacuagucgauagaggaugggguaacggaugugguuuauucggcaaaggaucauuaguuaccugugccaaauuugcauguucaaaaaaaaugacuggaaaaagcauacaacccgagaauuuagaauauaggauaauguugucuguccauggaucucaacacucagguaugauaguuaaugauacaggacacgaaacagaugaaaauagggcuaaaguagaaauaacacccaauaguccucgagcugaagcaacacucggaggauuuggaagucuaggacuagacugugaaccaagaacaggacuagacuuuagugaucuauauuauuuaacaaugaacaacaaacauuggcuaguacauaaagaaugguuucacgacauaccucuaccuuggcacgcaggcgcugauacaggaacaccacacuggaacaauaaagaagcacuaguugaauuuaaagaugcucacgcaaaaagacaaacagucgucguacuaggaagucaagaaggagcuguacauaccgcgcuagccggcgcuuuagaagccgagauggacggagcaaaaggaagauuaucaucgggacacuuaaaauguagauuaaaaauggacaagcuaagauuaaaaggagucucauauucacuaugcacagcagcauuuacauucacaaaaauuccugcggaaacacuacauggaacaguaacuguugaaguacaauaugcaggaacagauggacccugcaagguuccugcacaaauggcuguagauaugcaaacacuaacaccaguaggaagacuaauaacagcaaacccaguaauaacagaaucuacagaaaauucaaaaaugauguuggaauuagauccaccauuuggggauaguuauauaguaauagguguaggagaaaaaaaaauaacacaucacuggcauagaaguggcuccacgauaggaaaagcauucgaagcaacaguacgaggagcaaaaagaauggcaguacuaggagacacagcaugggauuucggauccguuggaggagcauugaauucauuagguaaagguauccaccaaauauuuggagcggcauuuaaaucguuauucggaggaaugaguugguuuucucaaauccuaauugguacacuacucaugugguuagguuuaaacacaaaaaaugguucaaucucauuaaugugcuuagcgcuuggaggaguacuaauauuucucaguacagcugugagugcugacguagguuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6925 - RNA, 2503 nt, Artificial Sequence
  ZIKV prME variant mRNA Design 2 opt
ggggcgcugccuacggagguggcagccaucuccuucucggcaucaagcuuaccaugauuauuaaugcaagaaaagaaaagaaaagaagaggugccgauacaagcguaggaauaguaggacuacuacuuacaacagcaauggcagccgaaguaacaagacgcgguucugcuuauuauauguaucuagacagaaaugaugcuggagaagccauuaguuucccaacaacauuaggaaugaauaaauguuacauacaaauaauggaccuaggacacaugugugacgcaacaaugucauaugaaugcccaauguuagacgaagguguugaaccagacgauguagauuguugguguaauacaacaucaacauggguuguuuauggaacaugccaucauaagaaaggcgaggcuagaagaucaagacgagcagucacauuaccuagucauaguacaagaaaauuacaaacaagaucucagacauggcuugaaucaagagaauauacaaaacacuuaauuagaguugaaaauuggaucuuuagaaacccugguuuugcacuagccgcagcugcaauagcuuggcuauuaggaucaucuacaucacaaaaaguaauauauuuagucaugauucuacuaauagcaccagcauauucaaucagaugcauaggagugagcaauagagauuuuguggaaggcaugucuggagggacauggguagauauuguauuagaacauggagggugcguaacuguuauggcacaggauaaaccaacaguagacauagaauuaguuacaacaacaguuucaaauauggcggaaguuagaaguuacuguuaugaagcaucaauuucagauauggcaucagauaguagauguccaacacaaggggaggcuuauuuagauaaacaaagugacacucaauauguauguaaacgaacauuaguagauagaggauggggcaacgguugugguuuauuuggcaaaggaaguuuaguaacaugugcaaaauuugcguguaguaagaaaaugacaggcaaaucaauacaaccagaaaacuuagaauaucgaaucaugcuuaguguacacggcucacaacauucaggaaugauuguaaaugacacuggacaugagacagaugaaaacagagcaaaaguggaaauuacaccuaacucaccaagagcagaagcuacguuaggagguuucggaucucuuggauuagacugugaaccaagaacaggcuuagacuucucugaucuauauuaucuuacaaugaauaacaaacauugguuaguacauaaagagugguuucaugauauaccauuaccauggcacgcaggagcagauacagggacgccacauuggaacaauaaagaagcucuaguagaauuuaaagaugcacacgcaaaaagacaaacaguaguuguuuuagguucucaagaaggagccguacacacagcacuagcuggagccuuagaagcagaaauggacggggcuaaagguagauuaucaucuggacacuuaaaauguagauuaaaaauggauaaauuaagauuaaaaggaguaaguuauagccuguguacagccgcauuuacuuuuaccaaaauaccagcagaaacauuacaugguacaguaaccguagaagugcaguaugcaggaacagaugggccuuguaaagucccagcucaaauggcaguagauaugcaaacacuuaccccaguaggcagacuuauaacugcaaauccagugauaacagaaucaaccgagaacuccaaaaugaugcuagaacuagauccaccauucggagauaguuauauaguuaucggagucggagaaaagaaaauaacucaucauuggcauagaucagguagcacgauaggaaaagcauuugaagcaacagucagaggugccaaaagaauggcaguauugggagauacagcaugggacuuuggaagugucggaggagcacuaaauagcuuaggaaaaggaauacaucaaauuuucggagcagcauuuaaaucuuuauuuggaggaaugagcugguucucacaaauacuuauaggaacauugcugaugugguuaggacucaauaccaaaaacggaagcauaucauuaaugugucuagcacugggaggugucuuaauauuccuaucgacagcaguaucagcagaugugggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6926 - RNA, 2500 nt, Artificial Sequence
  ZIKV prME variant mRNA Design 2 opt
ggggcgcugccuacggagguggcagccaucuccuucucggcaucaagcuuaccaugaucaacgcaagaaaagaaaaaaaaagacgaggagcagacacaaguguaggaauaguaggauuacuuuugacaacugcaauggcagcggaaguaacaagaagaggaagugcauauuauauguauuuagaccgcaaugaugccggugaagcgauaucauucccaacuacuuuaggaaugaauaaauguuauauacaaauaauggauuuaggacauaugugugaugcaacgaugagcuaugaaugccccauguuagaugaaggaguagaaccagacgauguagacuguugguguaauacaacaaguacauggguaguauauggaacgugucaucacaaaaaaggagaagcaaggagaaguaggagagcaguaaccuuaccaucccauagcacucgaaaauuacaaacaagaagccaaacaugguuagaaagucgagaauauacaaaacauuuaauaagagucgaaaauuggauauuuagaaauccaggauucgcauuagcagcagcugcaauagcauggcuauuagguucaucaacaagucaaaaaguaauauauuuaguaaugauuuuacuaauagcaccagcauauucaauaagauguauuggaguaagcaaccgcgauuuuguagaaggaaugucaggaggaacauggguagacauaguacuagaacauggagggugugucacaguaauggcacaagauaaaccaacgguagauauagaauuaguaacgaccaccguuucuaacauggcugaaguacgaucauauugcuacgaagcaucaauaagcgacauggcaucagauucuagauguccaacucaaggagaagcguauuuggauaaacaauccgauacacaauacguaugcaagaggacucuaguagauagggguuggggaaacggauguggguuauuuggaaaaggaaguuuaguuacaugugcuaaguuugcguguaguaaaaaaaugacaggaaagucaauucaaccagaaaauuuggaauacagaauaauguuaagcguacauggcucacaacacagcggaaugauagugaaugacacaggacaugaaacagaugaaaauagagcaaaaguagaaauaacaccaaauaguccaagagcagaagcgacacuaggagguuuugguucauuaggucuagauugcgaaccucgaacagguuuagacuuuucagaucuguauuauuuaacaaugaacaauaaacauugguuaguccauaaagaaugguuucacgauauaccuuuaccguggcacgccggagcagacacaggaacaccccauuggaauaauaaagaagcacuaguagaguuuaaagacgcucaugcaaaaagacaaacuguaguaguuuuggguagccaagaaggagccguacauacagcauuagcaggagcgcuagaagcagagauggacggcgcuaaaggaagauuauccuccggacauuuaaaaugucgauuaaaaauggauaaauuaagacuaaaaggaguaucauauaguuuaugcaccgcagcuuuuacauuuacaaaaauaccugcagaaacucuacauggaaccguaacaguagaaguucaauaugcaggcacagauggaccauguaaaguuccugcacaaauggcuguagauaugcaaacacucacacccguuggaagauuaauaacagcgaacccaguaauaacugaaagcacagaaaauaguaaaaugauguuagaauuagacccaccauucggagauaguuauauaguaauagguguaggagaaaaaaaaauaacucaccauuggcacagaucagggucaacuauuggaaaagcauuugaggcaacaguaagaggagcgaaacguauggcaguauuaggagacaccgcgugggacuuugguagcguaggaggagcauuaaacucguuaggaaaaggaauccaucagauauucggagcagccuuuaaaagucucuucggaggaaugagcugguucucacaaauuuuaauaggaacauuacuaauguggcuaggauuaaauacaaaaaauggcaguauaucauuaaugugcuuagcucuaggaggaguacuaauauucuuaaguacugcagucucagcugaugugggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6927 - RNA, 2497 nt, Artificial Sequence
  ZIKV prME variant mRNA Design 2 opt
ggggcgcugccuacggagguggcagccaucuccuucucggcaucaagcuuaccaugaacgcaagaaaagaaaaaaaacgucguggugccgauacaaguguaggaauaguaggauuauuguuaacaacagcaauggcagcagaaguaacacgaagaggaucagcauauuacauguauuuggauagaaaugaugcgggagaagcaauaucauuuccaacuacacuuggaaugaauaaauguuauauucaaauuauggauuuaggacauaugugcgacgcuacaaugucauacgaaugcccgauguuagacgaagggguggaaccagaugacgucgauuguugguguaauacaacgucaacguggguaguauauggaacaugccaucacaaaaaaggcgaagcuagaagaagucguagagcaguaacauuaccaagccauaguacaagaaaauuacaaacacgaucccaaacuugguuagaaucaagggaauacacuaaacauuugauaagaguagaaaauuggauauuuagaaauccggguuucgcccuugcggcagcagcaauagcaugguuacuaggaucuucaacaagucaaaaaguaauauauuuaguaaugauacuuuuaauagcaccagcuuauagcauaagaugcauugguguaaguaauagggacuuuguagaagguaugucagguggaacauggguagauauaguacuagaacauggagguugcguaacaguuauggcacaagauaaaccaacggucgacauagaacuaguuacaacaacaguuagcaauauggcagaaguaagaucauauuguuacgaagcaucuauaagcgacauggcaagugauucuagauguccaacacaaggagaggcauaccuugauaaacaaagugauacucaauauguaugcaaaagaacauuaguagaucgaggauggggaaacggguguggucuauuugguaaaggaucauuaguaacgugugcaaaauuugcauguucgaaaaaaaugacaggaaaaucaauacaaccagaaaacuuagaauauagaauaaugcucagcguacaugguucacaacauucaggaaugauuguaaaugauacaggucaugaaacagaugaaaaccgagcaaaaguagaaauuacuccaaauaguccaagagcugaagcaacacuuggagguuuuggaagucuaggacuagacugcgaaccaagaacuggauuagauuuuucugaucuauacuaucuaacaaugaacaauaagcauugguuaguacauaaagagugguuucaugauauuccacuaccuuggcaugcaggugcugauacaggaaccccacauuggaauaauaaagaagcuuugguagaauuuaaagaugcacaugcaaaaagacaaacuguaguaguauuaggaucacaagaaggagcaguacacaccgcacuagcaggagcuuuagaagcugaaauggauggagccaaaggaagauuauccaguggacauuuaaaaugcagauuaaagauggacaaacuacgacuaaaaggaguaagcuauucauuauguacagcagcauuuacauuuaccaaaauaccugcugaaacucuacacggaacaguaacaguagaaguacaauaugcggguacagauggaccauguaaaguaccagcucaaauggcuguagauaugcagacuuuaacaccgguaggaagauugauaacugcaaauccuguaauaacugaaucaacagaaaauaguaaaaugauguuagaauuagauccaccauucggagauucauacauaguaauuggugucggggaaaaaaaaauaacccaucauuggcauagaucaggaaguacaauaggaaaagcuuuugaagcaacaguaagaggagcaaaaagaauggcggugcucggagauacagcuugggauuuuggcaguguagguggugcacuaaauucauuagguaaaggaauacaucaaauuuuuggagcugcguuuaaaucacuauucggaggaaugucuugguuuucucaaauauuaauugggacuuuguuaaugugguuaggucuaaauacaaaaaaugggucaauaucacuaauguguuuagcacugggaggaguauuaauuuuuuuaaguacagcaguaagcgcagacguaggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6928 - RNA, 2494 nt, Artificial Sequence
  ZIKV prME variant mRNA Design 2 opt
ggggcgcugccuacggagguggcagccaucuccuucucggcaucaagcuuaccauggccagaaaagaaaaaaaaagaagaggagcugauacaucaguaggaauaguaggacuauuguugacaacagcaauggcagcagagguaacaagacgagguagcgcauauuacauguauuuagauagaaacgaugcaggagaagcuauaucauucccaacuacauuaggaaugaacaaaugcuauauacaaauuauggauuuaggacauaugugugaugcaacaaugaguuaugaaugcccuauguuagaugaaggaguagaacccgacgauguugacugcuggugcaauacgacaaguacauggguuguauaugguacaugucaucauaaaaaaggagaagcaagacgaaguagacgcgcagucacauuaccgagccauagcacgcguaaacuacaaacacgaucacaaacuuggcuagagaguagagaauauacuaaacauuuaaucagagucgaaaacuggauauucaggaaucccggauuugcauuagcagcagcagcaaucgcauggcuauuaggcucaaguacuagucaaaaaguaauauauuuaguaaugauauuacuaauugccccagcauacaguauaagauguauagguguaagcaaccgagacuucguagaaggaaugucuggaggaacauggguugacauuguacuagaacacggagguugugucacagugauggcgcaagauaaaccuacaguugauauugaacuaguuacaacaacaguaaguaacauggcugaaguaagaucauacuguuaugaagcaucuauaagugauauggcuagugacagucgauguccaacacaaggcgaagcauacuuagauaaacaaucagauacucaauauguauguaaaagaacacuagucgacagaggguggggaaacggauguggacuauuuggaaaaggaucgcuagugacaugugcaaaauuugcaugcucaaaaaaaaugacaggcaaaucaauacaaccugaaaauuuagaauaccggaucauguuaucaguccaugguucacaacauagcggaaugauagucaaugauacaggacaugaaacggaugaaaacagggcaaaaguagaaauaacuccaaacaguccaagagcagaagccacauugggaggcuuuggaagcuuaggauuagacugcgaaccgcguacaggcuuagauuucuccgaucuuuauuaucuaacuaugaauaauaaacauugguugguacauaaagaaugguuucacgacaucccauuaccuuggcaugcaggagcagauacaggaacaccacauuggaacaauaaggaagcauuaguagaauucaaagacgcacaugcaaaaagacaaacaguaguaguacuaggaucacaagaaggagcaguccauacugcucucgcaggagcguuagaagcagaaauggacggagcaaaagggcguuugagcucaggacauuuaaaaugcagauuaaaaauggauaaauuacgauuaaaaggaguaucuuacucgcuauguaccgcagcuuucacauucacaaaaauaccagcagaaaccuuacaugggacaguaacgguugaagugcaauaugcagggacagauggcccauguaaaguacccgcucaaauggcaguugacaugcaaacucuaacaccaguaggaagauuaauuacagcaaacccaguaauuacagaaaguacugaaaacaguaaaaugauguuggaacuagauccaccauuuggagacagcuauauaguuaucggcguaggugaaaaaaaaauaacacaucauuggcauagaagugguaguacgauaggaaaagcuuucgaagcuacgguaagaggagcaaaaagaauggcagucuugggagauaccgcaugggauuuugguaguguugguggugcauuaaauucauuagguaaaggaauacaccaaauauuuggagcagcauucaaaucuuuauucggagguaugaguugguuuucacaaauauugauaggaacauuacuaauguggcuaggcuuaaauacaaaaaaugguuccauaaguuuaauguguuuagcauuaggggguguguuaauauuuuuaucuacugcaguuagugcugauguaggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6929 - RNA, 2491 nt, Artificial Sequence
  ZIKV prME variant mRNA Design 2 opt
ggggcgcugccuacggagguggcagccaucuccuucucggcaucaagcuuaccaugagaaaagaaaagaaaagaagaggugcagacacuucaguaggaauugugggauugcuacuuacaacugcaauggcagcagaaguaacacgacguggaucugcauacuauauguacuuagacaggaaugacgcuggugaagcaauaaguuuuccaacaacauuaggcaugaacaaaugcuacauacaaauaauggaccuaggacauaugugugacgcaaccaugaguuacgaauguccaauguuagaugaaggaguagagcccgaugauguagauugcugguguaauacaacaagcacauggguaguguauggaacaugucaccauaagaaaggugaagcaagaagaucaaggagagcaguaacucuuccaucacauucaacgcgaaaauuacaaacaaggucacaaacaugguuagaaaguagagaauauacgaaacaccucauaagaguagaaaauuggauauucagaaaucccggcuuugcacuagcagcagcagcaauagcaugguuacugggaaguaguacaucacagaaaguaauauauuugguaaugauauuacuuauagccccagcauauucaauuagauguauaggaguuucgaauagagauuucguggaaggcaugaguggaggaacguggguagacauaguuuuagaacauggaggaugugucacagugauggcacaagauaaaccgacaguagauauagaauuagugacaacuacaguaaguaauauggcagaaguuagaaguuauuguuaugaagcauccauaagcgauauggcuucagauucaagauguccgacucaaggagaagcauauuuagauaaacaaagugacacacaauacguauguaaaaggacucuaguagauagaggaugggguaauggauguggguuauuugguaaaggaucuuuagucacaugugcaaaauucgcaugcaguaagaaaaugacaggcaaaaguauccagccagaaaauuuggaauauaggauaaugcuaucaguacacgguucucaacauuccggaaugauugucaaugauacaggucaugaaacagaugaaaacagggcgaaaguggagauuacaccaaacucaccaagagcggaagcaacacuagguggauuugguucauugggauuagauugcgaaccaagaacaggauuagauuuuucagaucuguacuauuuaacuaugaacaacaaacauugguuaguacauaaagaaugguuucaugauauaccauuaccauggcaugcgggagcagauacaggaacgccacacuggaacaacaaagaagcacucguagaauuuaaagacgcacaugcgaaacgacaaacaguaguaguauuaggaagccaggaaggagcaguacauacagcacuagcaggcgcauuagaagcagaaauggauggagcaaaagguagauuaaguaguggacauuuaaaauguagguuaaaaauggauaaacuaagauuaaaaggaguaaguuauaguuuaugcacugccgcauucacauuuaccaaaauaccugcagagacauuacauggcacaguaacaguugaaguacaauacgcaggcacagaugggccaugcaaagugcccgcucaaauggcaguagauaugcaaaccuuaacgccaguuggcagauuaauaacugcaaacccaguuauaacugaaucgacagaaaacagcaaaaugauguuagaacuagauccgccuuuuggagauucauauauaguaauuggaguaggagaaaagaaaauaacacaucacuggcauagaaguggaagcacaauaggaaaagcauuugaagcgacaguaaggggagcgaaaagaauggccguauuaggagauacagcaugggacuucgguaguguaggaggagcuuuaaauagucuaggaaaaggaauacaucaaauauuuggagcagcuuuuaaaucacuauuuggugguaugucaugguuuucacaaauauuaauaggaacauuacuaauguggcuaggccuaaauaccaaaaauggaaguauaaguuuaauguguuuagcauuaggugguguauuaauauuucuaaguaccgcaguaucagcagauguuggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6930 - RNA, 2488 nt, Artificial Sequence
  ZIKV prME variant mRNA Design 2 opt
ggggcgcugccuacggagguggcagccaucuccuucucggcaucaagcuuaccaugaaagaaaagaaaagaagaggugcagauacauccguaggcauaguagguuuguuauuaacaacagcaauggcugccgaagugacuagacguggaagugcauacuacauguauuuagauagaaaugaugcuggagaagcuauuucauuuccuaccacauuaggaaugaauaaauguuacauacaaauaauggaucuaggucacaugugcgaugccacaaugagcuacgaauguccaauguuagaugagggaguagaaccagacgauguugauuguugguguaauacaacaucaacguggguaguuuaugguacaugccaucauaagaaaggagaagcuagaagaucaagacgagcaguaacauuaccaagucacucaacuagaaaacuacaaacaagaagccaaacauggcuagaaagcagagaauauacuaaacaccuuauuagaguagaaaauuggauauuuaggaacccaggauuugcuuuagcggcugcugcaauugcauggcugcuuggaucaaguacaucucagaaagucauauaucugguaaugaucuuauuaauagccccugcauacaguaucaggugcauaggaguaucgaaucgugauuucguagaaggaaugagcgggggaacauggguugacauaguauuagagcauggaggauguguuacaguaauggcacaagauaaaccaacugucgauauagaauuaguaaccaccacaguaagcaacauggcagaaguaagaaguuauuguuaugaagcaucaauaagcgauauggcaucugacucacgauguccaacacaaggggaagcauaucucgauaaacagucagauacucaauauguuuguaaaagaacucuaguagaucgaggcuggggaaacggaugcggucucuucggaaaaggaucauuaguaacaugugcaaaguucgcauguaguaagaaaaugacaggaaaauccauacaaccagaaaauuuagaauauagaauuauguuaagcguacaugguucucaacacucaggaaugauaguaaaugauacaggccaugaaacagacgaaaacagagccaaaguagagauaacaccaaacaguccacgagcugaagcuacauuaggaggguucggaucauuaggacuggauugugaacccagaacuggucuagacuuuucagaccuuuacuauuuaacaaugaauaauaaacauuggcuaguacacaaagaaugguuucacgacauuccguuaccauggcaugcgggugcagauacaggcacaccacauuggaauaauaaagaagcucuaguagaguuuaaagaugcacaugcaaaacgacaaacagucguaguacuagguagucaagaaggagcaguacauacugcauuagcuggagcauuagaagcagaaauggauggagcaaaaggaaggcuaucauccggucaucuaaaauguagacuaaaaauggauaaacugagauuaaagggagucagcuauucauuauguacagcagcauucacauucaccaaaaucccagcagagacuuuacauggaacaguaacagucgaaguacaauaugcagguacagauggaccauguaaaguuccagcacaaauggcuguagauaugcaaacguuaacacccguugguagacuaauaacagcuaacccaguuauuacagaaagcacagaaaauucaaaaaugauguuagagcuagacccaccauucggugauagcuauauugucauaggagucggagaaaagaaaauaacacaccauuggcacagaucaggaucaacaauaggaaaagccuuugaagcuacaguaagaggagcaaaacgaauggccguauuaggugauacagcaugggauuuuggaucaguuggaggagcacuuaacucucuagguaaaggaauacaucaaauauuuggagcagcuuucaaaucucuauuuggugguaugaguugguuuagucaaauauuaauugguacauuacuaaugugguuaggucuaaauacuaaaaaugguucaauaaguuuaauguguuuagcauuaggaggcguuuuaauauuuuuaaguacagcaguaagcgcugacguuggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6931 - RNA, 2485 nt, Artificial Sequence
  ZIKV prME variant mRNA Design 2 opt
ggggcgcugccuacggagguggcagccaucuccuucucggcaucaagcuuaccauggaaaagaaaagaagaggagcagauacaaguguaggaauuguuggacuauuauuaacuacagccauggcagcagaaguaacgagaagggguagugcuuauuacauguaucuagacaggaaugaugcaggggaagcaauaucuuucccaacuacauuaggcaugaauaaauguuauauucaaauaauggaucuaggacauaugugugaugcaacaaugucauaugaaugcccaauguuagaugaggguguggaacccgaugauguagauugcugguguaauacaacaagcacauggguuguauauggaaccugccaucauaagaaaggagaagcaagaagaucuaggagagcagugacguuaccaagucauuccacaagaaaauuacaaacaagaucgcagacaugguuagaaagcagagaauacacaaaacacuuaauaagaguagaaaauuggauuuucagaaauccagguuuugcauuagcagccgcagcaauagcauggcuccuaggaucaaguacaucucaaaaaguuauauauuuagucaugauacuacuaauugcuccugcauauaguauaagaugcauagguguuaguaauagagauuuuguagaagggaugucaggagguacauggguagauauaguauuagaacauggaggauguguaacuguaauggcacaagacaaaccuacaguagauauagaacucguaacuacaaccguaaguaauauggcagagguaagaucauauuguuacgaagcaucaauaucagauauggcaucagauaguagaugcccuacgcaaggagaagcauaucuagauaaacaaagcgauacucaauauguauguaaacgaacuuuaguagauagaggguggggaaauggauguggacuauuugguaaaggaucuuuaguaacuugugcaaaauuugcuuguucaaagaaaaugacuggaaaaucaauucaaccagaaaauuuagaauaucgaauaauguuaucaguacauggaucgcaacacagcggaaugauaguaaacgauaccggacacgaaacugacgaaaacagagcaaaaguagagauaacacccaauaguccaagagcagaagcuacacuaggaggauuuggcagccuuggacucgacugugagccaagaacgggauuagacuuuagcgaucuauauuacuuaacaaugaauaacaaacauugguuaguccauaaagaaugguuucaugacauuccacuaccauggcacgcuggugcagauacuggaacaccgcacuggaauaauaaagaagcccuaguugaauuuaaagaugcacaugcaaaaagacaaacagucguaguauuagguucucaggaaggagcaguucauacagcauuagccggugcauuagaagcagaaauggauggagcaaaaggaagauuaaguucuggacaucugaaaugucgacuaaaaauggacaaacuaagauuaaaaggaguaucauacucauuauguacagcagcauuuacauucacuaaaauaccagcagaaacauugcacgguacaguaacaguagaagugcaauaugcuggaacugauggcccguguaaaguaccggcacaaauggcuguagauaugcagacauuaacaccaguaggaagauuaauaacagcaaauccuguaauaacagaaagcacagaaaacaguaagaugauguuagaauuagacccacccuucggggacagcuauauaguuauaggaguuggagaaaagaaaauaacacaucacuggcauaggucaggaucaacaauagggaaagcauucgaagcgacuguuagaggagcaaaaagaauggcgguauugggagauacugcaugggauuucggaucaguaggaggagcauugaauagucuaggcaaagguauacaccaaauauucggggcagcauuuaaauccuuauuugguggaaugaguugguuuagucaaauuuuaauaggaacuuuacugaugugguuaggacuaaauacuaaaaauggauccaucucauuaaugugucucgcgcuaggaggaguacuaauuuucuuaucuacagcaguaucagcggacguaggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6932 - RNA, 2482 nt, Artificial Sequence
  ZIKV prME variant mRNA Design 2 opt
ggggcgcugccuacggagguggcagccaucuccuucucggcaucaagcuuaccaugaaaaaaagaaggggagcugauacaagcgucggaauaguaggacuauuauuaacaacagcaauggcagcagaaguaacacgaagaggcagcgcuuauuauauguauuuagauagaaaugaugcaggugaagccauaucauuuccaacaacucuaggaaugaauaaauguuacauacaaauaauggauuuaggacauaugugugaugcaacaaugaguuaugaaugcccaaugcuggaugaagguguugaaccugaugauguagauuguugguguaauacaacaucaacauggguaguauacggaacaugccaucacaagaaaggagaagcaagaagaucaagaagagcaguaacacuaccaagucacucuacaagaaaauuacaaacaagaagucaaacgugguuagaaucaagagaauauacaaaacacuugauacgaguagaaaacuggaucuuuagaaauccaggauucgcccuugcagccgcugcaauugcaugguuacuagguaguaguacuagucaaaaaguuauauaccuugucaugauauuauuaauagcuccagcauacucaauaagaugcauaggcguaaguaauagagauuuugucgaaggaauguccggaggaacauggguugacauaguauuagaacacggaggauguguaacaguaauggcacaagauaaaccaacuguugauauugaguuaguuacaacuacaguaucaaauauggcagagguacgaaguuauuguuacgaggcaaguauaucugauauggcaucugauucuagauguccaacucaaggagaagcauaucuugacaaacaaucugauacacaauaugucuguaaaagaacauuaguagaucguggaugggggaacggauguggauuauucggaaaaggaucacuaguaaccugugcuaaauuugcauguuccaaaaaaaugacugguaaaucaauccaaccagaaaauuuagaauacaggauaauguuaucaguccacgguagucaacauagcgguaugauaguuaaugauacaggacaugaaacagaugaaaaucgagcaaaaguugaaauaaccccaaauucaccaagagcagaagccacacuagggggcuuuggaucauugggauuagacugcgaaccucgaacaggauuggacuucucugauuuauauuaucuaacgaugaacaauaaacacugguuaguacacaaagaaugguuucacgauauaccucuaccauggcaugcaggugcagacacaggaacaccacauuggaacaauaaagaggcacuaguagaauucaaagaugcgcacgccaaacgacaaacagucguaguuuuagguucacaagaaggagcuguacauacagcuuuagcaggggcguuagaagcagaaauggauggugcgaaaggacguuugucaucuggucauuuaaaaugucgauugaaaauggauaaacuacgacuaaaaggaguaagcuacucacuuuguacugcggcuuuuacauuuacaaaaauaccagcagaaacccugcauggaacuguuacuguagaaguacaauaugcuggcacagacggaccuuguaaaguuccagcccaaauggcaguagauaugcaaacacuaacuccaguaggaagacuuauaacagcaaauccagugauuacagaaucaacagaaaauaguaaaaugauguuagaacucgauccaccauuuggagauagcuacauagucauaggaguaggcgaaaaaaaaauaacacaccauuggcauagaagcggaaguaccauaggaaaggccuuugaagcgacaguaagaggagcuaaacgaauggcaguacuaggggauacggcaugggacuuugguagcguaggaggagcauuaaacucucucggaaaaggaauacaccaaaucuuuggagcugcauuuaaaucauuauuugguggcaugaguugguuuagccaaauccuaauaggaacauuauuaaugugguuagguuuaaacacaaaaaauggauccauuucauugaugugucuggcacuuggaggaguauuaaucuuucuuuccacugcaguaagcgcagauguaggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6933 - RNA, 2479 nt, Artificial Sequence
  ZIKV prME variant mRNA Design 2 opt
ggggcgcugccuacggagguggcagccaucuccuucucggcaucaagcuuaccaugaagcgaagaggagcagauacuucaguaggaauaguaggacuauuauuaacaacagcaauggccgcagaagucacaagaagaggaucagcauacuauauguaccuagauagaaacgaugcuggagaagcaauaucguucccaacaacacuaggaaugaauaaauguuauauucagauaauggaucucggacauaugugcgaugcaacaaugucauaugaauguccaauguuagaugaaggagucgaaccugaugauguagauuguugguguaauacaacaucaacauggguaguauauggaacaugucaucacaaaaagggcgaggcuagaagaucccguagagccgucacauuaccaucgcauaguacaagaaagcuacaaacacguucucagacauggcuagaaaguagagaauauacaaaacauuuaauccgagucgaaaacuggauauuccgcaauccaggguuugcacuagcugccgcagcuauugcauggcugcuagguucaucaacgucacaaaaaguuauauaccuagugaugauauuauuaaucgcaccagcauauaguauuagauguauagguguaaguaauagagacuuuguagaagguaugagcggaggaacaugggucgauauaguauuagaacauggcggaugugugaccguaauggcacaagauaaacccacgguagauauagaauuggucacaacuacuguaucaaauauggcagaaguaagaucauacugcuacgaagcaucaaucucagauauggccucagauuccagauguccgacccaaggagaagcauaucuagacaaacaaucggauacacaauauguauguaaacgaacgcuaguugauagaggauggggaaauggauguggauuauuuggaaaaggaaguuuagucacaugugcaaaauucgcaugcagcaagaaaaugaccggaaaauccauacaaccagaaaaucuagaauauagaauaaugcuaucaguacacggaagccagcauaguggaaugauuguaaaugauaccggacaugaaacugacgaaaauagagcaaaaguagaaauaacaccaaauaguccaagagcagaagcaacauuagggggauucggaucacuagguuuagacugcgaaccacgaaccggauuagauuucagugacuuauacuauuuaacaaugaauaauaaacauugguuaguacacaaagaaugguuucaugacauaccauuaccauggcaugcaggagcagacacaggaacaccacacuggaacaauaaagaagcauuaguagaauuuaaagaugcacaugcaaaacggcaaacaguaguaguauuaggaagucaagaaggcgcuguacacacagcacuagcuggagcauuggaagcagaaauggacggagcaaaaggaagguuaucaaguggacacuuaaaauguagauuaaagauggauaaacuaagacuaaaaggaguaaguuauucauuaugcacagcugcuuuuacauuuacuaaaaucccagcagaaacacugcacgggacaguaacaguugaaguacaauaugcagguacugauggaccauguaaaguaccugcucaaauggcaguugauaugcaaacauuaacaccaguagggagauuaauuacugcaaacccaguaauaacagaaucuacugaaaauucaaaaaugauguuagaauuagauccaccguuuggagauaguuauauaguaauaggaguuggagagaaaaagauaacacaucauuggcacagaagcggaucaacuauaggaaaagcauuugaagccacaguaagaggagcaaaaagaauggcaguguuaggagauacagcaugggauuuuggaucagugggaggugcacuuaauucauuaggaaaagguauucaccaaauauucggagcagccuuuaaaagucuuuucggggguaugaguugguucagccaaauacuaauaggaacacuacuuaugugguuaggauuaaauacuaaaaaugguaguauaucuuuaauguguuuagcauuaggcggaguacugauauuuuuaucaacagcgguuagcgcugacguggguugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6934 - RNA, 2476 nt, Artificial Sequence
  ZIKV prME variant mRNA Design 2 opt
ggggcgcugccuacggagguggcagccaucuccuucucggcaucaagcuuaccaugaggcguggcgcagauacaucaguagggauuguaggauuauuauuaacaacagcaauggcagcagaaguuacaagaagaggaagugcauacuacauguauuuagauagaaacgaugccggagaagcaauauccuuuccaacaacauuaggaaugaauaaauguuauauacaaauaauggacuuaggacacaugugugacgcaacuaugucauaugaaugcccaaugcuagaugaaggagucgaaccugaugacguagauugcugguguaauacaacaaguacauggguaguauauggaacaugucaucauaagaaaggcgaagcaagacgaucaaggagagcaguuacacugcccucacacucaacaagaaaacuacaaacaagaucacaaacuugguuagaaucuagagaauauacaaaacaucuuauaagagucgaaaauuggauauuuagaaacccaggauuugcauuagccgcagcagcaauagcaugguuauuagggaguucaacaucacagaaaguuauauauuuaguaaugauauuauuaauugcaccagcauacucaauaagauguauaggaguuucgaauagggauuucguagaaggaaugucgggagguaccuggguagauauaguuuuagaacauggcgguuguguaacaguuauggcacaagauaaaccuacaguagauauagaacuuguaacaacaacaguuagcaacauggcugaaguaagaagcuauuguuacgaagcaucaauaucagacauggcauccgauucaagaugcccgacacaaggagaagcauaucuagauaaacaaucagauacacaauauguaugcaaacgaacucuaguagacagaggcuggggaaacgguugcggacuauucggaaaagguagccuaguaaccugugcuaaauucgcauguucaaagaaaaugacuggaaaaucaauucaaccugaaaacuuagaauauagaauuauguuaagcgugcauggaagccaacauucagguaugauugucaaugauacgggacaugaaacagaugaaaaccgugcaaaaguagaaauaacaccaaauuccccgagggcagaagcaacacuagggggauuuggaucacuaggcuuagauugugaaccuagaacuggauuagauuuuagugaucuauauuaccuaacaaugaacaauaaacauugguuaguucauaaagaaugguuucaugauauuccauuaccguggcacgccggugcagauacagguacgccacacuggaauaacaaagaagcauuaguagaauuuaaagaugcacaugcuaaacgucaaacugucguaguauuagguucacaagaaggagcaguacauacagcauuagcaggagcccuagaagcggaaauggauggagcaaaaggacgccuaucaaguggacacuuaaaaugucgcuuaaaaauggacaagcuaagauuaaaaggagucaguuauucucuaugcacagccgcuuucacauucacgaaaaucccugcggaaacacuucacggaacaguaacuguagaaguucaauacgcagguacagacggcccguguaaaguaccagcccaaauggccguagauaugcaaacauuaacaccaguaggaagacuaauaacugcaaauccaguuauaacagaaucgacagaaaacagcaaaaugauguuagaacuagacccaccauuuggagauucuuacaucguuaucggaguaggagaaaagaaaauuacacaccacuggcauagaaguggaucaacaauuggaaaagcauucgaagcaacgguaagaggagccaaacgaauggcaguuuuaggagacacugcaugggacuucggaagcguaggaggugcauuaaacucguuagggaaaggcauucaucagauauuuggagcagcauucaaaucauuauucggagguaugucaugguuuagucaaauacuaauuggaacuuuacuaaugugguuggguuuaaacacuaaaaacgguaguauaucacuuauguguuuagccuuaggcggaguguuaauauuuuuaucaacagcaguaagcgcugauguagguuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6935 - RNA, 2473 nt, Artificial Sequence
  ZIKV prME variant mRNA Design 2 opt
ggggcgcugccuacggagguggcagccaucuccuucucggcaucaagcuuaccaugagaggagcugauacaucaguaggaauuguagguuuauuacuaacaacagcaauggcagcagaaguuacaagaagaggaucagccuauuauauguauuuagaucgaaacgaugccggagaagcaauaaguuuuccaacaacuuuaggaaugaauaaaugcuauauacaaaucauggaucuuggacacaugugugacgcaacaauguccuacgaauguccaauguuagacgaaggaguagaaccugacgacgucgauuguugguguaauaccacaucaacauggguaguuuacgguacaugccaucauaagaaaggagaagcaaggcgaucaaggagagcaguaacauuacccucacauaguacaagaaaauuacagacuagaucacaaacauggcuugaaucgagagaauacacuaaacaccuaauaagaguagaaaacuggauuuuuagaaauccaggauuugccuuagcagcagcagcgauagcauggcuacuugggucuaguacaagucaaaaaguaauuuacuuaguaaugaucuuacuaauugcaccagcauacucaauaagaugcauuggaguaucaaauagagacuuugucgaagguaugagcgguggaacuuggguagacauugucuuggagcacgguggaugcguaacuguaauggcacaagacaaaccaacaguggacauagaauugguaacaacaaccguaaguaauauggcagaaguuagauccuauugcuacgaggcaucaauaagugacauggcaagugauucaagauguccaacacaaggagaggcuuaucucgauaaacaaagugauacccaauauguauguaaaagaacauuaguugacagagguuggggaaauggcuguggacuauucgguaaagggagcuuaguaacaugugcaaaauuugcauguucaaagaaaaugacaggaaaaucuauacaaccagaaaaucuagaauauaggauuauguuaagcguucauggaucgcaacauaguggaaugauugucaaugacacaggacaugaaacugacgaaaaccgagcuaaaguggaaauaacaccaaauucaccacgagcagaagcuacacucggaggcuucggaucacuaggauuggacugugaaccaagaacagguuuagauuucagcgaucuauauuauuuaacuaugaauaauaaacauugguuagugcauaaagaaugguuucaugauauaccauuaccuuggcacgcaggagcagauacaggcacaccacacuggaauaauaaagaagcccuaguagaauuuaaagaugcacacgcuaaaagacaaacaguaguuguacuaggaucacaagaaggugcuguacauacagcacuugccggggcauuagaagcagaaauggauggagcuaaaggaagauuaagcucaggucacuuaaaauguagauuaaaaauggauaaauuaaggcuaaaaggaguaagcuacucuuuauguaccgcagcuuucacauuuacaaaaauaccagcagaaacauuacauggaacaguaacuguagaaguacaauaugcagguacagaugguccauguaaaguaccagcacagauggcaguagauaugcaaacauuaacaccaguagggagauugauaacagcuaauccugucauaacagaaucaacugaaaauagcaaaaugaugcuagaacuagauccaccauucggugauucauauauaguaauaggaguuggagaaaagaaaauaacgcaucacuggcauagaagcgguaguacaauaggaaaagcauuugaggcaacaguaaggggcgcaaaaagaauggcuguauuaggagauacagcaugggauuucggaagcgucgguggagcacuaaauucacuaggaaaagguauucaucaaauauucggagcagcuuuuaaaucuuuguuuggaggaaugaguugguuuucucaaauacuaauuggaacauugcugaugugguuaggacuaaacacuaaaaacggaucaauuagcuuaaugugucuagcucucggagguguauugauauuuuuaucaacagcuguaucagcggacguuggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6936 - RNA, 2470 nt, Artificial Sequence
  ZIKV prME variant mRNA Design 2 opt
ggggcgcugccuacggagguggcagccaucuccuucucggcaucaagcuuaccaugggagcugauacaagugucggaauagucggacuauuacuaacuacagcuauggcagcggaaguuaccagaagaggcagcgcauauuauauguauuuagauagaaaugaugcaggagaagcaauauccuuuccuaccacucuaggaaugaauaaauguuauauacaaauaauggaccuaggacacaugugcgaugccacuaugaguuacgaaugcccuaugcuugaugaaggagucgaaccugaugauguagauugcugguguaauacaacaaguacauggguaguauacggaacaugccaucauaagaaaggagaggccagaagaucaaggagagcaguaacacuacccucucauucaacaagaaaauuacaaacaagaagccaaacaugguuggaaaguagagaauauacaaaacaucuaauucgaguagaaaauuggauauuuaggaacccaggauuugcacuagcagcagcagcaauugcuugguuacuaggaucaucaacaucacaaaaaguaauauaccuaguaaugauacuauuaauagcaccagcauauaguauaagauguauaggaguaucuaaccgagauuuuguugaaggaaugagcgggggaacauggguagauauaguguuagaacauggaggauguguuaccguaauggcacaagauaaacccacaguggacauagagcuaguuacaacuaccgucucaaauauggcagagguacgaagcuauugcuaugaagcgagcauaagugauauggcaagugauagccgauguccuacccaaggagaagcauaucuagauaaacaaucagacacucaauauguaugcaaacgaacauuaguugacagaggaugggggaauggauguggacuauuugggaaaggaucucuaguaacaugugcaaaauuugcuuguagcaagaaaaugacagguaaaucaauacaaccagaaaauuuagaguaucgaauuaugcuaagugugcauggaucacaacauucggguaugauaguaaaugacacuggacaugaaacugacgaaaauagagcgaaagucgaaauaacaccaaauuccccaagagcggaagcuacucuaggaggcuucggaagucuggguuuagauugugaaccuagaaccggacuagauuucucugauuuauauuauuuaacaaugaauaauaaacauugguuaguacauaaagagugguuucaugauauuccacuaccauggcaugcuggugcggauacaggaacuccacauuggaacaauaaagaagcauuaguugaauuuaaagacgcacaugcuaaacgacaaacagucguaguacuaggaagucaagaaggagcuguucacacagcucuagcaggagcauuagaagcagaaauggauggagcaaaaggaagauuaucaaguggacaucuaaaauguagauuaaaaauggacaaacuuagauuaaaaggaguaucuuauucucuauguacagcugccuuuacauuuacaaaaauaccugcugagacauuacacggaacaguuacaguugaaguucaauaugcaggcacugauggaccauguaaggucccagcucaaauggcaguagauaugcaaacauuaacaccaguuggaagauuaauaaccgcaaauccuguaauaacagaaagcacagaaaauucaaaaaugauguuagagcuagauccaccauuuggagacucauacauaguaauaggaguaggugaaaagaaaauuacacaucauuggcauagaucaggaaguacaauagguaaagcauuugaagcaacaguaagaggagcaaaaagaauggcaguccuuggcgauacugcaugggauuuuggaucaguuggaggagcacuaaacucucuaggcaagggaauacaucaaauauuuggagcagcuuucaaaaguuuauuuggaggaaugucaugguuuucucaaauacuaauaggaacauuacuuaugugguuaggacuaaauacuaaaaacggcaguauaucucuaauguguuuagcauuaggagguguuuuaauauuucuuucuacagccguaucggcagauguuggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6937 - RNA, 2467 nt, Artificial Sequence
  ZIKV prME variant mRNA Design 2 opt
ggggcgcugccuacggagguggcagccaucuccuucucggcaucaagcuuaccauggcugacacaucaguuggaauaguaggacuauuauuaacaaccgcaauggcagcagaaguaaccagaagaggaucagccuauuauauguaucucgauaggaacgacgcaggcgaagcaauaucauuuccuacaacacuagguaugaauaaauguuauauucaaauaauggaucugggacauaugugcgacgcaaccauguccuaugaauguccuauguuagaugaagguguagagccagaugauguugacuguugguguaauacaacuaguacuuggguaguauacggaacaugucaucauaaaaaaggagaggcccgaagaucaaggagagccguaaccuuaccaagucauucaacaagaaaauuacaaacuaggagucagacuuggcuagaaagucgagaauauaccaaacauuuaauacgaguagaaaauuggauuuuucgaaauccaggauuugcacuugcugcugcugcgauugccugguuacuuggaagcucaacaagucaaaaaguaauuuauuuaguuaugauauuauuaauagcaccagcuuacagcauuagauguauaggagugucaaauagagacuuuguagagggcaugaguggagguacguggguagauauaguauuagaacauggaggaugcgugacaguaauggcacaagacaaaccaacgguagauauagaauuaguaacaacuaccguaucgaauauggcagaaguacgaucauauugcuaugaagcaucaauaagugauauggcuuccgacagcagaugcccuacucaaggagaagcauacuuagauaagcaaagugauacccaauauguuugcaaacgcacacuaguagauagaggaugggguaauggaugugguuuauuuggcaaaggaagucugguaacaugugcuaaauuugcaugcucaaaaaaaaugacaggaaaaucaauacaacccgaaaauuuagaauauagaauaauguuaagugugcaugguucacaacauagcggaaugauuguaaaugauacuggacaugaaacagaugaaaauagagcaaaaguagaaauaacaccaaacaguccaagggcggaagccacacuagguggauuugguucauugggacuagacugugaaccgcgaacuggcuuagauuuuagcgauuuauauuauuuaacaaugaauaacaaacauugguuaguacacaaagaaugguuccaugacauuccacuuccauggcacgcuggcgcagauacuggaacaccucacuggaauaacaaagaagcacuaguggaauucaaggacgcacacgcaaaaagacaaacaguaguaguucuaggaucacaagaaggagcaguacauacagcuuuagcgggagcauuagaagcagaaauggauggagcaaaaggaagacuaucaagcggacaucuaaaauguagguuaaaaauggacaaacuaagauuaaaaggagugucauauaguuuauguacagcagcauucacuuuuacaaaaauuccagcugaaacauuacaugguacaguaacaguugaaguucaauaugcuggaacagauggaccauguaaaguaccagcacaaauggcaguagacaugcaaacacuaacacccguuggccggcuaaucacagcaaauccaguaauuacagaaucaacugaaaauucaaaaaugauguuagaauuagauccacccuuuggagauaguuacauaguaauaggcguaggagaaaaaaaaauuacacaucauuggcauagaucugggucaacaauuggaaaagcguuugaagcaacaguaaggggcgcuaaacguauggcaguucuaggagauacggcuugggauuucggcucaguaggaggagcacuaaauucauuaggaaaaggaauacaucaaauuuuuggagcagcauucaaaucauuauuuggaggaaugagcugguucucacaaauuuuaauaggcacauugcuaauguggcuaggauuaaauaccaaaaaugguucaauauccuuaauguguuuagcauuaggaggaguuuuaauauuuuuaaguacagcaguaucagcagacguuggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6938 - RNA, 2464 nt, Artificial Sequence
  ZIKV prME variant mRNA Design 2 opt
ggggcgcugccuacggagguggcagccaucuccuucucggcaucaagcuuaccauggauacaucaguugguauaguaggacuauuguuaacaacagcaauggcggcagaaguaacaagaagaggaucagcguacuacauguaucuagauagaaacgaugcaggugaagcaauaucauucccaacgacccuaggcaugaacaaauguuauauacaaaucauggaucuaggucauaugugugaugcaacaaugucuuaugaaugucccauguuagaugaaggcguagagccugaugacguagacuguugguguaauacaacaaguacauggguaguuuauggaacaugucaucauaaaaaaggagaagcaagaagaagcagacgagcugugacacuaccuucacacaguacaagaaaauuacaaacaagaucacaaaccugguuggaaagcagagaauauacaaaacacuuaauacgaguagagaacuggauuuuuagaaauccagguuucgcauuagcugcagcagcaauagcauggcuauuagguaguucaacaucucaaaaaguaauauauuugguaaugauauuacuaauagcuccagcuuauaguaucagauguaucggcguaucaaauagagacuuuguugaagguaugucaggaggaacaugggucgauauaguucuugaacaugguggauguguaacaguaauggcacaagacaaaccuacaguagauauagaauuaguaaccacaacaguaucaaacauggcugaaguaagaucuuauuguuaugaagcaagcauaucagauauggcaagcgacagcagaugcccaacacaaggagaagcuuaccuagacaaacaaagugauacucaguacguauguaaacggacacuuguggauagagguuggggaaacggauguggauuauuuggaaaaggcaguuuaguaacaugcgcaaaauuugccuguucaaaaaaaaugaccggaaaaucaauacagccagaaaaucuagaauaccguauaauguuaaguguacaugguagucaacauagugggaugaucguaaaugauacaggacaugaaacagacgaaaacagagcgaaaguagaaauuacaccuaauucaccaagagcagaagcaacauuagguggauuuggcucacuuggauuagauugcgaaccaagaacuggacuagauuuuucagauuuauacuauuuaacaaugaauaauaaacauugguuaguucacaaagaaugguuucaugauauaccucuaccuuggcacgcgggagcagacacaggaacaccucacuggaauaauaaagaagcuuuaguugaauuuaaagaugcucacgcaaaacgacaaacuguaguugucuuagguucucaagaaggagcaguacauacugcauuagcaggcgcucuagaggcagagauggauggagcaaaagguagauuaucgaguggacauuugaaaugcagauuaaaaauggacaaauuaagguuaaaaggaguaaguuacucauuauguacagcagcauuuacauuuacaaaaauaccagcagaaacauuacacggaacuguaaccguugaaguacaauaugcagguacagauggaccaugcaaaguaccagcacaaauggccguagacaugcagacauugacuccaguaggaagauuaauaacagcaaauccaguaauaacugaaagcacggaaaauaguaaaaugaugcucgaauuagauccaccauuuggagauaguuacaucguaaucggaguuggcgaaaaaaaaauuacacaccacuggcauagaucugguucaacaauaggaaaagcauucgaagcaacaguacgcggagccaaacgaauggcaguuuuaggagauacagccugggauuuuggcaguguaggaggcgcucucaauagucuuggaaaaggaauacaucaaaucuuuggagcagccuuuaagagucuguucggaggaaugaguugguucucacaaauacuaauagguacguuauuaauguggcuaggauuaaacacaaagaaugguucaauaucuuugaugugucuagcuuuaggaggcguacucaucuuuuugucaacagcaguaucagcugauguaggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6939 - RNA, 2461 nt, Artificial Sequence
  ZIKV prME variant mRNA Design 2 opt
ggggcgcugccuacggagguggcagccaucuccuucucggcaucaagcuuaccaugacaaguguaggaauuguaggauuacuacuaacaacagcuauggcagcagaaguaacaagaaggggcucagcauauuauauguauuuagauagaaacgaugcuggggaagcaauaagcuucccuacaacauuaggaaugaacaaauguuacauacaaauuauggacuuagggcauaugugugaugccacaaugucuuaugaaugcccaauguuagaugaaggaguagagccugacgauguagacuguugguguaauacaacaucaacuugggugguauauggcacaugucaucauaaaaaaggcgaagcacgaagauccaggagagcuguaacacuaccaucacauaguacaagaaaauuacaaacaaggucucaaacaugguuagaaucucgcgaauauaccaaacaccuuauaagaguagaaaauuggauauucagaaauccaggcuucgcacuagcagcugcagcuauagcaugguuauuaggaucguccacaucacaaaaagucauauauuuaguaaugauacuauuaaucgcaccagcauauucaauaagguguauaggagugucaaacagagauuuuguugaaggaauguccggaggaacauggguggacauaguucuugaacacggaggauguguuacaguuauggcucaagauaaaccaaccguugacauagaauuaguaacaacaacuguaaguaauauggcagaaguaagaaguuacuguuaugaagcaagcauaucagauauggcaucagacucaagaugcccaacacaaggugaagcauauuuggauaaacaaucagauacacaauauguauguaaaagaacacuaguagauagagguugggggaacggauguggauuauuuggaaaaggcagcuuaguaacaugugcaaaauuugcaugcagcaaaaaaaugacaggaaaaucuauacaaccagaaaaucuagaauacagaauaauguugucaguacaugggucacaacauucaggaaugauaguaaacgauaccgggcacgaaacagacgagaaccgagcgaaaguugaaauaacaccaaacagcccaagagcugaagcaacauuagggggauucggcucauuaggacuagauugcgagccaagaacaggauuagacuuuucagaucuguauuauuuaacaaugaacaauaaacauugguuaguucauaaagaaugguuucacgauauuccauuaccauggcaugcgggagcagauaccggaacaccacauuggaauaacaaagaagcuuuaguagaauucaaagacgcacaugcaaaaagacaaacaguuguaguauuagguagccaggaaggggccguacauacagcacuugcaggagcauuagaggcagaaauggauggugcuaaaggcagacuaaguaguggacaucuaaaauguaggcuaaaaauggauaaauugagacucaaaggagucucauauagucuauguaccgcagcauucacauuuacaaaaauaccugcagaaacacuucauggaacaguaacuguugaaguacaauacgcagggacugauggaccauguaaagucccagcacaaauggcaguagauaugcaaacauuaacaccuguugguagguuaauaacagcaaacccugugauaacugaaucuacagaaaacagcaaaaugauguuagaguuagacccaccauuuggagauaguuauauagucauaggaguaggcgaaaaaaaaauaacucaucauuggcacagaucaggcaguacgauagguaaagcauuugaggcaacaguacgcggagcgaaacgaauggcaguacuaggagauacagcaugggauuucggcucaguuggaggagcauuaaauucacuuggaaaaggcauacaccaaauauuuggugcagcauucaaaagccuauuuggaggaaugucaugguuuagucaaauauuaauaggaacauugcuaauguggcuuggauuaaauacaaaaaauggauccauaucacuaaugugccuagcauuaggaggaguauuaauauuccuaucuacggcagugagcgccgauguaggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6940 - RNA, 2461 nt, Artificial Sequence
  ZIKV prME variant mRNA Design 2 opt
ggggcgcugccuacggagguggcagccaucuccuucucggcaucaagcuuaccaugacuagcguaggaauagucggacuucuauugacaaccgcuauggcagcagcaguuacaagaagaggcuccgcauauuacauguaccuagacagaaaugaugccggagaagccauaagcuuuccaacaacacuaggaaugaauaaauguuacauucaaaucauggaucucggacauaugugugaugcaacaaugaguuaugaauguccaauguuagacgaaggaguagaaccugaugaugucgauugcuggugcaauacaacaucaacaugggucguauauggcacuugccaccauaaaaagggagaagcuaggcguucacgaagagcaguaacacuaccaucccauucaacuagaaaauuacaaacccgaagucaaacuugguuagaauccagagaauauacaaaacacuugauaagaguagaaaauuggauauuuagaaauccagguuucgccuuagcagcugcagcaauugcaugguuacuaggaagcucaacaucacaaaaaguuauauacuuaguaaugauacuauuaauagcuccagcuuacucaauaagauguauaggaguuucaaauagggauuucguagaagggaugucaggagguacaugggucgacauaguauuagaacauggaggaugcguaacaguuauggcucaagauaaaccaacggucgauaucgaacuuguuacaacuacaguaucuaauauggcagaaguaagaaguuauuguuaugaggcaucuauaagugauauggcuagugauaguagauguccaacacaaggugaagcauacuuagauaaacaaucugacacacaauauguuuguaaaagaacacuaguagaccgaggauggggcaacggguguggauuauuuggaaaaggaaguuuaguaacaugcgcaaaauuugcauguucaaaaaaaaugacaggaaaaucgauucaaccugaaaaucuagaauauagaaucaugcuuucaguucacggaucacagcauaguggaaugauaguaaaugauacaggucacgaaacggacgaaaauagagccaaaguagaaauaacuccgaauucaccaagagcggaagccacucuuggcggauuuggaucauuaggauuagauugugaaccaaggacaggacuagauuucucagaucuauauuaccuuacaaugaauaacaaacauugguuaguacacaaagaaugguuucaugauauaccacuaccuuggcacgcaggagcugauacugguacaccacacuggaacaacaaagaagcguuaguagaauuuaaagaugcacaugcaaaaagacaaaccguaguaguacucggaagccaagaaggagcaguacauacagcucuagcuggagcauuagaagcagaaauggacggagcaaaaggaagauuaucuaguggccaccuuaaauguagauuaaaaauggauaaguuaagacucaaagguguaucauacucauuauguacugcugcauuuacauucacgaaaauaccugcagaaacacuacauggaacuguaacuguugaaguccaauaugcagguacagauggaccauguaaaguaccagcacaaauggcugucgauaugcaaacguuaacuccuguaggacgauuaauaacagcaaauccaguuauaacggaauccacagaaaacucaaaaaugauguuagaauuagauccaccauuuggagauucauauauaguuaucgguguuggagaaaaaaaaauaacucaucauuggcauagaagugguucaaccauaggaaaagcauuugaggcaacuguaagaggagcaaaaagaauggcugugcugggagauacagcuugggauuuuggaagugugggcggagcauuaaauagcuuagguaaagguauacaucaaauauuuggagcagcauuuaaaucacuauuugguggaaugucaugguuuagucaaauacugauagguacucuuuugaugugguuaggauuaaauacaaaaaauggaagcauaaguuuaauguguuuagcauuaggaggaguauuaauauuucuaagcacagcaguaucagcugacguaggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6941 - RNA, 2473 nt, Artificial Sequence
  ZIKV prME variant mRNA Design 2 opt
ggggcgcugccuacggagguggcagccaucuccuucucggcaucaagcuuaccaugagaggagcagauaccaguguaggaauaguaggucuauuauuaacaacagcuauggcagcagccguaaccagaagaggaagugcauauuauauguaccuugacaggaaugaugcgggugaagcaauuaguuuuccaacaacacuugggaugaauaaauguuauauucaaauuauggaucuuggucauaugugugaugcaacaaugagcuacgaauguccuaugcucgaugaaggaguagaaccagaugauguagauuguugguguaauacaacgagcacuuggguaguauauggaaccugccaucauaagaaaggggaagcuagaagaaguaggagagcaguaacacugccaucacauucgacaagaaaacuacagacaagaagucaaacaugguuggaaaguagagaauacacaaaacauuuaauuagaguagaaaacuggauauuuagaaauccuggauucgcauuagcagcagccgccauagcuugguuguuaggaaguagcacaagucaaaaagugauauauuuaguuaugauauuacuaauagcuccugcauauaguauaagaugcauaggaguaaguaauagagacuuuguugaagguauguccgggggaacauggguagacauaguacuagaacauggaggauguguuacaguuauggcacaagauaaaccuacaguggauauugaacuuguaacuacaacggucucaaauauggcagaaguacgaucauauuguuacgaagcaaguauaucugauauggcaucugacucaagaugcccaacgcaaggagaagcauaccuugauaaacaaagugauacacaauacguaugcaaaagaacucuaguagacagaggauggggaaauggcuguggauuauucggcaaaggaucucuuguuacaugcgcaaaauuugccugcucgaagaaaaugacaggaaaaaguauucaaccagaaaauuuagaauauagaauaauguuaagugugcacgguucacaacauuccgguaugaucguaaacgauacaggacaugaaacagaugaaaauagagcuaaaguagagauuacaccaaauaguccacgagccgaagcaacacucggcggauuuggcaguuuagguuuagauugcgaaccgagaacagguuuagauuuuucagauuuauauuauuuaaccaugaacaauaaacauugguuaguccauaaagaaugguuucacgacauaccucuaccauggcaugcaggagcagauacagguaccccucauuggaauaauaaagaggcuuuaguagaauuuaaagaugcacacgcaaaaagacaaacagugguuguauuagguagccaagaaggugcaguacauacagcucuagcaggagcauuagaagcggaaauggauggugcaaaaggaagauuaaguucagggcacuuaaaauguagauuaaagauggacaaguuacgauuaaaaggaguaucauauagccuauguacagcggcauuuacauuuacuaaaauaccagcagaaacacuacacggaacaguaacaguugaaguacaauaugcuggaacagauggccccuguaaaguaccagcacaaauggcaguagacaugcaaacacuaaccccaguaggaagauuaauaacagcaaauccgguaauuacugaaucuacugaaaauagcaaaaugaugcuagaauuagauccaccauucggcgacagcuauauagucauaggggugggagaaaagaaaauuacacaucauuggcacagaucaggaaguacuaucgguaaagcauuugaagcaacaguaagaggagcuaaaagaauggcaguacuaggggauacagcaugggacuuuggaagugucgguggagcacuaaauucuuugggaaaagggauacaccaaauauuuggugcagcauuuaaaaguuuauucgguggaaugucuugguucagucagauacuaauuggcacucuuuuaaugugguuaggucuaaauacgaaaaaugggucaauaucucuaaugugucuagcauuaggagguguuuuaaucuucuuaagcacagcaguaucagcagacguaggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6942 - RNA, 2497 nt, Artificial Sequence
  ZIKV prME variant mRNA Design 2 opt
ggggcgcugccuacggagguggcagccaucuccuucucggcaucaagcuuaccaugcgaggacugucaucaagaaaaagaagaucacaugauguacuuacaguacaauucuuaauauuaggaauguuacuaaugacaggaggcguaacaagaagagguagcgccuacuauauguaucuagauagaaaugaugcaggagaagcaaucaguuucccuacaacccuugguaugaauaaaugcuauauacaaauaauggauuuggggcacaugugugacgcuacaaugaguuacgaauguccaauguuagaugaaggagucgaaccagaugauguagauugcugguguaacaccacaucaacaugggugguauacgggacaugccaucauaagaaaggagaagcaagacguucaagacgagcuguaacauuaccaagucauagcacaagaaaauuacaaacuagaucacaaacaugguuagaaucccgagaguacacaaaacaucuaauaagaguggaaaauuggauuuuuagaaauccagguuucgcauuagcugcagccgcuauagccugguuauuagguucaucuacaagucaaaaaguaauauauuuaguaaugauauuacuaauagcaccagcauauucuauaagauguauaggagucucaaauagagauuucguagaagguaugagcggaggaacuuggguagauauuguacuagaacaugguggcuguguaacaguaauggcucaagauaaaccuacaguagauauagaauuaguaacaacgacaguaucaaauauggcagaaguuagaucuuauuguuacgaagcaagcaucucagauauggcaagugacaguagaugcccaacacaaggggaagcauaucuagacaaacaaucagacacucaauauguauguaaaagaacuuuaguugaccgaggauggggaaaugguuguggacuauucgguaaaggaucauuaguuacuugugcgaaauucgccugcagcaagaaaaugacaggaaaaucaauccaaccagaaaacuuagaauacagaauaaugcuaaguguacauggaagccagcacaguggaaugauaguaaaugauacaggccaugaaacagaugaaaauagagcaaaaguagaaauaacaccaaauucaccgagagcugaggcaacacuaggaggauuugggagcuuaggauuagauugugaaccaagaacaggccuagacuuuagcgauuuauauuacuuaacaaugaauaauaaacacuggcuaguacacaaagaaugguuucaugacauaccuuuaccauggcaugcaggagcagacacugguacaccacauuggaacaauaaagaagcauuaguagaauuuaaagacgcccaugcgaaaagacaaacgguaguaguacuaggaagucaagaaggggcaguacauacagcuuuagcuggugcauuagaagcugaaauggauggagcaaaagguagacuauccucaggucacuuaaaauguagacuaaaaauggacaaauuaagguugaaaggaguaucauacaguuuauguacagcagcauuuacauuuacuaaaauaccugcagagacacugcauggaaccguuacaguggaaguacaauacgcaggaacagauggaccauguaaaguaccagcacaaauggcgguagauaugcaaacacuaaccccgguagguagauuaauaacagcaaacccugugauaacagaaagcacugaaaacucaaagaugauguuagaauuagacccaccauucggugauaguuauauaguaauaggagucggagaaaagaaaauaacacaucacuggcauagaagugguucaacaauagguaaagcguucgaagcaacaguucgaggagcaaaaagaauggccguacuaggagauacugcaugggacuuuggaucaguaggaggagcuuuaaacucucuagguaaagguauucaucaaauauucggggcugcuuuuaagagcuuauuuggcggaaugucuugguuuucacaaauauuaauaggaacacuauuaauguggcuaggacuaaauacgaaaaauggaagcauaagucugauguguuuagcacugggaggaguacucaucuuccuaagcacagcaguuucagccgauguaggauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6943 - RNA, 2497 nt, Artificial Sequence
  ZIKV prME variant mRNA Design 2 opt
ggggcgcugccuacggagguggcagccaucuccuucucggcaucaagcuuaccaugcgaggacuaucaucaagaaaaagaagaucacaugacguccuuacaguacaauuuuuaauauuaggaauguuauuaaugaccggagcaguaacuagacgaggaucagcauauuacauguaccuagaccgaaaugacgcaggagaagcuauaucauuuccuacaacccuaggaaugaacaaauguuacauacaaauaauggauuuaggacauaugugugaugccacaaugucauaugaauguccaaugcucgaugaaggaguagaaccggaugacgucgauuguuggugcaacacaacuucgacuuggguaguauacgguacuugucaucauaagaaaggagaagcgagacguucaaggagagcagugacacuaccgucucacucaacaagaaaauuacaaacaagaucacaaacgugguuagaaagcagagaauauacaaaacacuuaaucagaguggaaaauuggauauuuaggaacccaggcuucgcuuuagcagcggcagcaauagcaugguuacuaggauccagcacaucacaaaaaguaauauacuugguaaugauauuacuaauugcuccagcauacucaauuagauguauagguguaaguaacagagauuucguugaaggaaugaguggaggaacaugggucgauauaguacuugagcauggcggaugcguaaccguaauggcacaagauaagccaacuguagauauagaacugguuacaacaacagucucuaauauggcagaaguaagaagcuauuguuaugaagcgucaauaucagauauggcgucagacucaagaugccccacccaaggagaagcauaucuagauaaacaaagugacacacaauauguaugcaaaaggacucuaguagauagaggauggggaaauggguguggauuauucggaaaagggucccuaguaacaugcgcaaaauuugccugcucaaagaaaaugacagggaaaucaauucaaccagaaaaccuagaauacagaauaauguuaagcguucauggaagucaacauucggguaugauuguaaacgauacaggacaugaaacugacgaaaauagagcgaaaguugaaauaacaccuaauucaccaagagcagaagcaacucucggaggauucggaagucuuggacuggauugcgaaccacgaacaggguuagauuuuagcgaccuauauuaucuaacgaugaauaacaaacauugguuaguacacaaagaaugguuucaugacaucccacuaccauggcaugcaggagcagacacagguacgccacauuggaauaacaaagaagccuuaguagaauuuaaggaugcacaugcaaaaaggcaaacuguaguugucuuaggaagccaagaaggcgcaguacauacagcauuagcuggagcuuuagaggcugaaauggauggagcaaaagguagguuaucaaguggacauuuaaaaugucgauuaaaaauggauaaauuaagguuaaaaggaguaucuuauucauuaugcacagcagcauuuacauuuacaaaaauaccagcagaaacccuacaugguacaguaacaguagaaguccaauaugcaggcacagauggaccaugcaaaguuccagcucaaauggccguagauaugcaaacuuuaacacccguuggaagacuaauaacagcaaauccaguaauaacagaaucaacagaaaauaguaaaaugaugcuagaacuagaucccccauuuggcgauagcuauauagucauaggggucggagaaaagaaaauuacacaucacuggcaucgaucaggcaguacaauagguaaagcauuugaagcaacaguacgaggagcuaaaagaauggcaguccuaggagauacagcuugggacuuugguucaguaggaggagcauuaaacucauuaggaaaagguauacaucaaauauuuggagcagcuuucaaaucauuauuuggaggcaugucuugguuuagucagauacuaauaggaacucuauuaaugugguuaggcuuaaauacuaaaaauggaagcauaucuuuaaugugucuagcuuuagguggaguauuaauauuuuuaagcacagcuguaucagcugauguaggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6944 - RNA, 2497 nt, Artificial Sequence
  ZIKV prME variant mRNA Design 2 opt
ggggcgcugccuacggagguggcagccaucuccuucucggcaucaagcuuaccaugaggauaauaaaugcccgcaaagaaaagaaacggagaggagccgauacaucuguagguauuguaggauuauuauuaacaacagcgauggcagcagaaguaacaagaagaggaucagcuuauuauauguauuuagacagaaacgaugcaggagaagcaauuagcuuuccaacuacauuagguaugaauaaauguuauauacaaauaauggauuuaggacauaugugugaugcgacaauguccuaugaauguccaaugcuagaugaagguguagagccagaugauguagauugcugguguaauacaacaucaacaugggucguauauggaacaugccaucauaagaaaggugaagcaaggcguaguaggagagcaguuacauuaccaucucauucuacuagaaaacuacaaacaagaucacaaacaugguuagaaagucgagaauauacuaaacauuuaauaagaguagaaaacuggauuuuuagaaacccaggauuugcacuagcugcagcugcaauagcaugguuguugggaagcaguacaagucagaaaguaauuuauuuaguaaugauauuauuaauugcaccagcauauucaauuagauguauagguguaucuaacagagacuuuguagagggcaugucaggaggaacauggguugauauuguuuuagaacaugguggauguguaacuguaauggcucaagauaaaccaacaguagacaucgaauuagugacuacaacaguaucaaacauggcugagguuagauccuauuguuaugaagccucaaucagcgauauggccagugauaguagauguccaacacaaggugaagcauauuuagauaaacaaagugauacgcaauauguuuguaaaaggacguuaguagaucggggcuggggaaacggaugcggcuuauuuggaaaaggaaguuuaguaacaugugcaaaauuugcaugcucaaagaaaaugacagguaaaagcauucagccugaaaauuuagaauauagaauaaugcuaaguguacauggcagucaacauucaggaaugauuguaaaugacacgggacacgaaacagacgaaaacagagcaaaagucgaaauaacgccuaauaguccaagagcagaagcaacuuuagguggauuuggaagccuuggacuagauugugaaccacgaacugguuuggauuucagugauuuauacuauuuaacuaugaauaacaaacacugguuaguacauaaagaaugguuucaugacaucccauuaccauggcaugcaggagcggauacugggacaccacauuggaacaauaaagaggcguuagucgaguucaaagaugcacaugcgaaacgacagacaguaguaguauugggaagucaagaaggagccguacacacagcauuagcuggagcauuagaagcugaaauggacggagcaaaaggaagauuaucaucuggacacuugaaauguagauuaaaaauggauaaacucagacugaaaggaguaagcuacagucuauguacagcagcauucacauuuacaaaaauuccugcagaaacacuacauggaacaguuacaguagaaguacaauaugcaggaacagauggaccauguaaaguaccggcacaaauggcuguagacaugcaaacacuuacgccuguaggaagguuaauuacagcaaacccugugauaacagaaaguacggaaaauucaaaaaugauguuagaacuagacccuccauucggugauaguuauauagucauaggaguaggugaaaagaaaauuacacaccauuggcaucgcucaggcucaacaauaggaaaagcguuugaagcgacaguaaggggagcaaaaagaauggcaguguuaggggauacagcaugggauuucggaucgguaggaggugcauugaauagucuaggaaaagguauucaccaaauauuuggagcagcguucaaaucauuauuuggggguaugaguugguucucacaaauauuaauagggaccuuauuaauguggcuaggacuaaauacgaaaaaugguucaauuagucucauguguuuagcauuagguggaguauugauauuccuaaguacagcaguauccgcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6945 - RNA, 2494 nt, Artificial Sequence
  ZIKV prME variant mRNA Design 2 opt
ggggcgcugccuacggagguggcagccaucuccuucucggcaucaagcuuaccaugauaauuaacgcaagaaaagaaaaaaagagaaggggggcagacacaucuguaggaaucguaggguuauuauuaacaacagcuauggcagccgaaguaacgcgaagaggaucagcuuauuauauguauuuagacagaaacgaugcaggagaagcaauaaguuuuccaacuacucuaggaaugaauaaauguuacauacaaauaauggauuuaggacacaugugugacgcaacaaugagcuaugaaugcccaauguuggaugaaggcguagagcccgaugauguggauuguugguguaauacaacaagcacuugggugguauauggcacuugccaucacaaaaaaggcgaagcaagaaggucuagaagagcaguaacauuaccaucccacucaacaagaaaauuacaaacaagaucccaaacauggcuagaaucuagagaauauacaaaacauuuaauucgcguagaaaauuggauauucagaaauccgggguuugcacuagcagcagcugcaauagcauggcuauuaggaucaucgacaagccaaaaaguaauauauuuaguaaugauacuacucauagcaccugcauacucaauaagauguaucgguguaucaaauagagauuucguggaaggcaugagugguggaacauggguugacauaguuuuagaacauggagguuguguuacuguaauggcucaagauaaaccaacaguagauauagaacucguaacaacaacaguuucaaauauggcggaaguaagaaguuauuguuaugaagcuucuauuucagauauggccagcgacagucguugcccaacacaaggugaagcauaucuagacaagcaaagugauacucaauauguaugcaaaagaacacuaguagacagagguugggguaauggaugugguuuauuuggaaaaggaagccuaguaacaugcgcaaaauuugcuugcaguaaaaaaaugacagggaaaaguauacagcccgaaaaccucgaguauagaauaauguuaucuguacauggaucacaacacagcggaaugauaguaaaugauacaggacacgaaacagaugaaaacagagcaaaagucgaaauaacaccaaauaguccucgagcugaagcuacauuaggaggauucggaucgcuaggguuagauugcgaaccuagaacuggauuagacuuuucugauuuauauuaccugacaaugaacaacaaacacuggcuuguacauaaagaaugguuccaugauauuccauuaccauggcaugccggagcagauacaggaaccccccauuggaauaauaaagaagcauuaguagaauucaaagacgcgcacgcuaaaagacaaacaguaguaguacuaggaucacaagaaggagcuguacauacagcauuggcaggagccuuagaagccgaaauggacggagcaaaaggucgucuuucaagcggacauuugaaauguagacuaaaaauggauaaacucagacuaaaagggguaucauauucacuauguacagcagcauuuacauuuacaaaaauaccagcagaaacauuacaugguacagucacaguagaaguucaauaugcaggaacagaugguccguguaaaguaccugcacaaauggcaguagauaugcagacauuaacaccgguugguagguuaauuaccgcaaauccaguaauaacagaaaguacagaaaauucaaaaaugauguuagaauuagauccaccauuuggagacagcuauauaguaauaggaguaggugaaaaaaaaauaacacaucauuggcauagaaguggaucaacaauaggaaaagcauuugaagcaacggucagaggagcaaaaagaauggccguuuuaggggauacagcaugggauuuuggaaguguagguggagcauuaaacucuuuagguaaaggcauacaucaaauauuuggagcggcuuuuaaaaguuuauucggugguaugucaugguuuagucaaauacuaauaggaacuuuauuaaugugguugggauuaaauacaaaaaacgguucgauuaguuuaaugugcuuagcauuaggcggaguauuaauauucuuaaguacggcgguaagugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6946 - RNA, 2491 nt, Artificial Sequence
  ZIKV prME variant mRNA Design 2 opt
ggggcgcugccuacggagguggcagccaucuccuucucggcaucaagcuuaccaugauaaaugcaaggaaagaaaaaaaaagaagaggagcagauacauccguuggaauaguuggacugcuauuaacaacagcuauggcagcagagguuacacgaagaggaagcgcauauuauauguaucuagauagaaaugaugcaggagaagcuauaaguuuuccgacaacauuaggaaugaauaaauguuauauacaaauaauggaccuaggacauaugugugaugcaacaaugaguuaugaauguccaauguuggacgaaggaguagaacccgacgacguagauuguugguguaauacaacaagcaccuggguaguauauggcacaugucaccauaagaaaggagaagcaagaagaucacgaagagcgguaacauuaccaucacauucuacacgaaaauuacaaacaaggucacaaacaugguuagaaagcagagaauauacaaaacauuuaauucgaguggaaaauuggauauuuagaaauccaggauuugcacuagccgcagcagcaauagcaugguuacuaggaucaucaacaucacaaaaaguaauauauuuaguaaugauacuacuuauagcaccagccuacucaauuagaugcauuggaguaucuaauagagauuucguagaaggaaugagcggaggaacuuggguggauauuguauuagaacacggaggauguguaacaguaauggcucaagauaagccaacaguagacauagaauuaguaacaacuacaguaaguaauauggccgaggucagaagcuacugcuaugaagcaucaauuucagauauggcaagcgauucaagauguccaacacaaggugaagcuuauuuggacaaacaaagugacacacaauauguaugcaaacgaacacugguagaucgcggauggggaaauggauguggauuauuuggaaaagggucauuaguaacaugugcaaaauucgccuguucaaaaaaaaugacuggaaaauccauucaacccgaaaaucuagaauauagaauaauguuaaguguacauggaucacaacauucugguaugauaguaaaugauacaggucaugaaacagaugaaaaccgcgcaaaaguagaaauaacaccuaacucaccuagagcagaagcaacacuaggaggauuuggaagcuuaggguuggacugugaaccuagaacaggacuggacuuuucugacuuauauuaucuaacaaugaacaauaaacauugguuaguacauaaagaaugguuccaugauauaccauuaccauggcaugcaggagcugauacaggaacaccucacuggaacaauaaagaagcacucguagaauuuaaagaugcccaugcgaaaagacaaacuguaguaguuuuaggaucccaagaaggcgcuguacacacugcacuagcuggggcauuagaagccgaaauggacggugcaaagggacgauuaucauccggacauuugaaaugucguuuaaaaauggacaaauuaagacuaaaaggaguaucguauucacuauguacagcagccuuuacuuuuacaaaaauaccagcagaaacauuacauggaacaguuacaguugaaguacaauaugccggaacagacggaccaugcaaaguuccagcacaaauggcuguagauaugcaaacauuaacuccaguaggcagauugauaacagcaaacccugucauaacagaaucaacugaaaacaguaaaaugaugcuugaacuagaccccccauuuggagacucauacauaguaauagggguaggugaaaaaaaaauaacacaccauuggcauagaaguggauccacaauagguaaagccuuugaagcaacuguacguggagcaaaaagaauggcagucuuaggggauacagcaugggauuuuggaucaguaggaggagcuuuaaacucuuuaggaaaaggaauacaucaaauauuuggagcagcauucaaaucacuuuuuggaggaaugucaugguuuucucaaauucuaaucgggacacuacuuauguggcuaggauuaaauaccaaaaacggcaguauaucacugauguguuuggcauuagguggaguuuuaauauuuuugagcacagcggugucagcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6947 - RNA, 2488 nt, Artificial Sequence
  ZIKV prME variant mRNA Design 2 opt
ggggcgcugccuacggagguggcagccaucuccuucucggcaucaagcuuaccaugaaugcgaggaaagaaaagaaaagaagaggugcagauacaucagucggaauaguaggacuguuauugacaacagcgauggcagcagaaguaacaagaagaggaagcgcauauuauauguacuuagauagaaacgaugcuggugaagcaauaucauuuccuacaacauuaggaaugaacaaauguuauauacaaauaauggauuugggacauaugugugaugcuacaaugaguuaugaauguccaauguuggaugaaggaguagagccagacgauguagauuguugguguaacacaacaucaacauggguaguauaugggacuugucaccauaagaaaggggaagcucgacgaagccguagagcgguaacgcuaccaagccauagcacaagaaaauuacaaacgagaagucaaacuugguuagaaagcagagaauacacaaaacauuuaauaagaguagaaaauuggauauucagaaacccaggguuugcacuagcggcggcugcaauagcauggcuccuaggaucaucaacaucacagaaaguaauauaccuaguaaugauacuacuaauagcuccugcauauaguaucagauguauaggaguaaguaaucgagauuuuguagaagguauguccgguggaacguggguagacauaguacuagaacauggaggauguguaacagucauggcacaagacaaaccgacaguagacauagaauuaguuacgacaacaguaucaaauauggcagaagugagaucuuauuguuacgaagcaagcauaagcgacauggcaagugacagccguuguccaacacaaggagaagcauacuuagauaaacaaagugauacacaauauguauguaaaagaacgcuaguugacaggggcuggggaaacggaugcggcuuauucggaaaaggaucucuaguuacaugugcaaaauuugcauguucaaagaaaaugacaggcaaaucaauacaaccggaaaauuuagaauauaggauaauguuaucagugcaugguucacaacauucaggaaugauaguuaacgauaccggucaugagacagacgaaaauagagcaaaaguagaaauaacacccaacucaccaagagcagaagcaacacuagguggauucgguagcuuaggauuagacugugaaccaaggacaggauuggauuuuagugaccuauauuaccuaacaaugaauaauaaacacuggcuaguacauaaagaaugguuucaugauauaccguuaccuuggcaugcuggugcugauacagggacuccacauuggaauaauaaagaagcauuaguagaauuuaaagaugcgcacgcgaaaagacaaacgguaguaguauuagggucacaggaaggagcaguacauacugcacuagcaggagcauuagaagcagaaauggauggagcuaaaggaagacucagcucagggcacuuaaaaugcagauugaaaauggauaaauuaagacuuaaagguguuaguuauucucucuguacugcagcauuuacuuucacuaaaauaccggcagaaacacuucauggcacaguaacagucgaaguacaguacgcaggaacagaugggccauguaaaguaccagcacaaauggcuguagauaugcaaacguuaacaccuguaggacgauuaauaaccgcaaaccccguaauuacagaaucaacagaaaacucaaaaaugaugcuugaauuagacccaccauucggagauagcuauauaguaauaggagugggagaaaagaaaauaacacaucauuggcauagaagcgguucuacaauagguaaagcauucgaggcaacgguuagaggggcaaaaagaauggcgguauuaggagacacagcuugggauuucggaagcguagguggagcauuaaauucacuuggaaaagguauacaucaaauauuuggagcagcauucaaaaguuuauucggagguaugucaugguuuagucaaauuuugauaggaacauuacugaugugguuaggguuaaauacuaaaaacggaagcauuagcuuaaugugucuugcucuaggaggcguauuaauauucuuaagcacagcaguuagugcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6948 - RNA, 2485 nt, Artificial Sequence
  ZIKV prME variant mRNA Design 2 opt
ggggcgcugccuacggagguggcagccaucuccuucucggcaucaagcuuaccauggcuagaaaagaaaagaaacgaagaggcgcagauacaucaguaggaauaguuggucuauuacuaacaacugcaauggcagcagaaguaaccagaaggggaagugccuauuauauguaucuugauaggaaugaugcuggugaggcaauaucauuuccuacaacucuuggaaugaauaaaugcuacauacaaauaauggauuuaggucauaugugcgaugccacaaugucauacgaaugcccaaugcuagaugaaggaguagaaccugaugauguagacuguuggugcaacacaaccaguacauggguaguauauggaacuugucaucacaagaaaggagaagcaagaagaaguagacgagcaguaacgcuaccaagccacucaacacggaaauuacaaacaagaagccaaacaugguuagaaagcagagaguauacgaaacaccucaucagaguagaaaacuggauauuuagaaacccgggauuugcauuagcagcagcggcaauagcauggcuauuaggaaguuccacaagucaaaaaguuaucuacuuaguaaugauacuuuugauagcaccagcauacucaauuagauguaucgggguuucuaauagagauuuuguagaaggaaugaguggagguacauggguagauauaguauuagaacacggaggaugugucacaguaauggcacaagauaaaccaacaguugacauagaauuagugacaacaacaguaagcaauauggcagaaguacgauccuacuguuacgaagcaaguauaagcgauauggcuagugacucacgauguccuacucaaggugaggcuuaccuagauaaacaaagcgauacgcaguauguaugcaaaagaacauuaguagacaggggaugggguaacggaugcgggcuauuuggaaaaggcucucuuguaacaugugcaaaauucgcuuguaguaagaaaaugacggguaaaucaauacaaccagaaaaucuagaauauagaauaauguuaaguguacauggaucucaacauagugggaugaucguaaaugauacaggucacgaaacagacgaaaacagagcuaaaguagaaauaacaccaaauagcccgagagcagaagcuaccuugggaggauuuggaagccuaggucuugauugugaacccagaacaggauuagauuucucagauuuauauuaccuaaccaugaauaauaaacauuggcugguacauaaagaaugguuucaugauauaccuuuaccauggcacgcgggggcagacaccgguacuccacacuggaauaauaaagaggcauuaguagaauuuaaagacgcacaugcaaaaaggcaaacaguagugguacuagguagccaagaaggagcaguacauaccgcauuagcaggagcacuagaggcugaaauggauggagcaaaaggaagacuaucaucaggacaucuuaaaugucgauuaaaaauggacaaauuaagauuaaaagggguaagcuauaguuuaugcacggcagcuuuuacauuuaccaaaauaccagcagaaaccuuacaugguaccguaaccguugaaguucaauaugcuggaacagacggaccauguaaaguacccgcacaaauggcaguagauaugcaaacacuaacaccaguugggcgacugauaacugcaaauccaguaauaacagagucaacagaaaacucaaagaugauguuagaauuagauccaccauuuggugauucauauauaguaauaggaguuggagaaaagaaaaucacacaucauuggcauagaagcggaaguacuauaggaaaggcuuuugaagcaacaguaagaggagcaaaacgaauggcagucuuaggagauacugcuugggauuucggaaguguaggaggagcuuuaaacagccucgguaaagggauacaucaaauauuuggagcagcauuuaaaaguuuauuuggaggaaugaguugguuuucacaaauauuaauuggcacauuacuuauguggcuagguuuaaauacgaaaaacggaagcauauccuugaugugcuuagcacuuggagggguacuaauauucuugaguacagcaguaagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6949 - RNA, 2482 nt, Artificial Sequence
  ZIKV prME variant mRNA Design 2 opt
ggggcgcugccuacggagguggcagccaucuccuucucggcaucaagcuuaccaugagaaaagagaaaaaacgaagaggcgcagauacuaguguaggcaucguaggacuauuauuaacaacugcuauggcagcagaaguuacaagaagaggcagcgcauauuacauguauuuagaccgaaaugacgcaggagaagcuauuucauucccaacaacauuaggaaugaacaaauguuauauacaaauuauggacuuaggccacaugugugaugcaacaaugucauaugaauguccaauguuagaugaaggaguagaaccagaugauguagacuguuggugcaauacaacaaguacauggguaguauacgguacaugucaucauaaaaaaggugaagcaagaagaucuaggagagcaguaaccuuaccaucacauucaacaagaaaauuacagacaagaagucaaacgugguuagaaaguagagaauauacaaaacaucuaauuaggguagaaaauuggauauucagaaauccgggauuugcauuagcagccgcagcaauagcauggcuauuagggucuucaacaagucagaaaguaauuuaccuaguaaugauauuacuaauagcaccggccuacaguauacgguguauaggaguaaguaacagggauuucguugaaggaaugaguggagguacauggguagacauaguauuagaacaugguggauguguaacuguuauggcacaagauaaaccuacaguagacauugaacuaguuacaacaacaguuaguaacauggcagaaguaaggaguuauuguuaugaagcuucaauaagugauauggcaucagauucacguuguccuacacaaggagaagcuuauuuagauaaacaaagugauacacaauacguauguaaaagaacauuaguagaucgaggauggggaaaugguuguggucuauucggcaaagguucuuuaguaaccugugcaaaauuugcuugcagcaaaaaaaugacuggaaaaaguauccaaccagagaacuuagaauauagaauaauguuaaguguacauggaagccaacacucaggaaugauaguaaaugauacaggacaugaaaccgaugagaauagagcuaaaguagaaauaacaccaaacucaccucgagcugaagcaacauuaggaggauucggaucguugggauuagacugugaaccgagaacuggacuagauuuuucugauuuauauuauuuaacaaugaauaauaaacacugguuaguucauaaagaaugguuucaugauauaccauuaccuuggcaugcaggugcugauacuggaacaccacacuggaauaauaaagaagcauuaguagaauuuaaggaugcacacgcgaaaagacaaacaguaguaguuuuaggaagccaagagggagcaguacacacagcucuagcaggagcguuagaagcagaaauggauggugcaaaaggacgauuaucaucaggacaucuuaaaugucgacuaaaaauggacaaacugagacuaaaaggaguaucauauaguuuauguacagcagcguuuacauuuacuaaaauaccugcggaaacacuucauggaacuguuacgguagaaguacaauaugcaggaacugauggaccaugcaaaguaccggcccaaauggcaguagacaugcaaacuuuaacaccagucggaagauuaauaacugcaaaccccguaauaacagaaagcacugaaaacaguaaaaugauguuagaacuugaucccccauucggagauagcuauauaguuauaggcguaggagaaaagaaaauaacacaucauuggcacagaucaggaucaacaauaggaaaagcuuuugaagcuacagugagaggagcaaaaagaauggcaguauugggagauacagcuugggauuucgguucuguuggcggagcgcuaaauagucuaggaaaaggaauacaucaaauauucggugcugcauuuaaaucauuguucggaggcaugucaugguuuagccaaauuuuaauaggaacacuauuaaugugguuaggauuaaacaccaaaaauggcucuauuucacuaaugugcuuagcauuaggagguguauuaauauucuuaaguacagcgguuagugcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6950 - RNA, 2479 nt, Artificial Sequence
  ZIKV prME variant mRNA Design 2 opt
ggggcgcugccuacggagguggcagccaucuccuucucggcaucaagcuuaccaugaaagagaaaaaaagaagaggagcagauacgucaguaggaauuguaggauuauuauugacaacagcaauggcagcugaagugacucguagaggaucagcauacuauauguauuuggaucguaaugacgcaggugaagcaauuucuuuuccuacaacauuagguaugaauaaguguuauauacaaauaauggacuuaggacacaugugugaugcaacaaugucauaugaaugcccuauguuagacgaagggguagaaccagacgauguugauuguugguguaauacuacaucaacauggguaguauacggaacaugucaccauaaaaaaggagaagcacgcagaaguagacgagcaguaacacuaccuucacauucaacaagaaaacuacagacgagaucacaaacuuggcuagaaaguagagaauacacaaaacaucuaauaagaguagaaaauuggaucuuuagaaauccagguuuugcguuagcagcagcagcaauagcuugguuguuagggucgucaacuagccaaaaaguaauauaucuaguaaugauauuauuaaucgcaccggcuuauaguauaagaugcauaggaguuaguaaucgagauuuuguagagggaaugucaggaggaacuuggguagauaucguucuagaacacggaggauguguaacaguaauggcacaggauaaaccaacaguugauauugaauuaguaacaacaacaguaagcaacauggcagaaguaaggaguuauugcuacgaagcuaguauaucagauauggcaagugauucaagauguccuacacaaggugaagcauauuuagauaaacaaagcgacacacaauaugucuguaaaagaacauugguugauagagguuggggaaaugguugcggauuauucggcaaagguucucuaguaacuugcgcaaaauuugcauguucaaaaaaaaugacagguaaaagcauacaaccagaaaacuuagaauauaggauuauguuaucgguucauggcucgcaacauagcgguaugauuguaaaugauacaggacacgaaacagacgaaaacagagcaaaaguagaaauaacuccaaauagcccaagagcagaagccacacuagguggauuugguaguuuaggacuagauugugaaccaagaacaggauuagauuuuagugaccuauauuauuuaacaaugaauaauaaacacugguuaguucauaaagaaugguuucacgauauuccauuaccuuggcaugcaggugcggacacaggaacgccacauuggaacaauaaagaagcuuuaguagaauucaaagaugcucaugcaaaaagacaaacaguaguaguacuaggaagucaagaaggagcgguacauacagcacuagcaggugcauuagaagcagaaauggauggagcgaaaggcagacuaucaucuggacaucuaaaauguagauuaaaaauggacaaacuaaggcuaaaaggaguaaguuacucacuauguacagcagcauucacauuuacaaaaauuccagccgaaacguuacacggaacaguaacggucgaagugcaauaugcaggaacugauggacccuguaaaguaccugcucaaauggcaguagauaugcaaacacuuacaccaguaggaagauuaauaacagcuaauccaguaauaacagaaucuacagagaacucaaaaaugaugcucgaauuagacccaccauucggugauaguuauauaguaauaggaguaggagaaaagaaaauaacacaucacuggcacagaucagguucaacaauuggaaaggcauuugaagcuacuguuagaggagcaaaacgaauggcaguauugggugacacggcaugggauuuuggaucaguaggaggagcuuugaauucucuaggcaaaggaauacaccaaauauucggagcagccuucaaaucucuauuuggagguaugagcugguucucacaaauauuaauagguacuuuauuaaugugguuaggauuaaacacuaaaaauggaucaauaucccuaauguguuuagcguuaggagguguauuaauauuccuaaguacagcugucagcgccgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6951 - RNA, 2476 nt, Artificial Sequence
  ZIKV prME variant mRNA Design 2 opt
ggggcgcugccuacggagguggcagccaucuccuucucggcaucaagcuuaccauggaaaaaaaaagacgaggggcggauacaucaguaggaauaguugguuuauuauuaacaaccgcaauggcagcagaaguaacuagaagaggaucagcauauuauauguauuuagauagaaaugaugcaggagaggcaauaucauuuccuacaacacuuggaaugaauaaauguuacauacagauuauggauuugggacacaugugugacgcaacaaugaguuacgaaugcccaaugcuagaugaagggguagaaccagacgacguggauuguugguguaacacaaccucaacgugggucguauacggaacaugccaccauaaaaaaggagaagcccgacggagucgaagagcagugacauuaccaagucauucaacgagaaaauuacaaacuagaagccaaacaugguuagaaagccgagaauacacaaaacaucuuauucgaguagaaaauuggauauuuagaaaucccggguuugcacuagcagcagcagcaauagcaugguuacuaggaucaucaacaucccaaaaagugaucuacuuaguaaugauauugcuuauagcgccagcauauaguauaagguguaucggaguaaguaauagagauuucguagaagguaugaguggaggaacauggguugacauaguuuuggagcauggcgggugcguaacaguaauggcacaagacaaacccacgguagacauagaauuagugacuacuacuguaucaaauauggcagaaguuagaagcuacuguuacgaagcaucaauaucugacauggcaagugauaguagauguccaacccaaggagaagcauaucuagauaaacaaucagauacacaauacguauguaaaagaacucuuguagaucgagguuggggaaaugguugcggcuuauuuggaaaaggaaguuuaguaacaugugcaaaauuugcauguucuaaaaaaaugaccgguaaaucgauacagccggaaaaccuagaauaccgaauuauguuaaguguacaugguucgcagcauucaggaaugauagugaacgacacaggucaugaaacagaugaaaaucgugcuaagguagaaauuacaccaaacucgccaagagcagaagcaacacuaggaggauuugguucacugggauuggauugugaaccuagaacaggccuugauuucucagauuuauauuauuuaacaaugaauaauaaacauuggcuuguacauaaagaaugguuucaugauauaccauuaccauggcacgcuggagcagacacggguacaccacauuggaacaacaaagaagcacuaguagaauuuaaggacgcccaugcaaaaagacaaacugugguaguacuagguagucaagaaggagcuguacauacugcucuggcaggggcauuagaagcugaaauggauggugcaaaaggaagauuaucaaguggacacuuaaaaugcagacuaaaaauggacaaauuaagauuaaaaggaguuucauauaguuuauguacagcagcauuuacuuuuacaaaaauuccagcagaaacauuacauggcacaguaacuguagaaguccaauaugcaggaacagacggaccuuguaaaguuccagcacaaauggcaguagacaugcaaacguuaacaccaguuggaagacuuauaacugcaaauccaguaauaacagaaaguacagagaauaguaaaaugaugcuagaauuagauccaccuuucggagauucauauauuguaauagguguaggagaaaaaaaaauaacacaccacuggcaucgaagugguaguacuauaggaaaagcauuugaagcuacagucaggggagcaaagagaauggccguacuaggagauacagcaugggacuucggaagcguuggaggugcccuaaauucauuagggaaagguauacaccaaauauucggcgccgcauuuaaaagccuauuuggaggaaugaguugguuuucacaaauacuaauaggcacauuauuaaugugguuaggcuuaaacacaaaaaauggaucaauaagucuaauguguuuagcauuaggaggaguauuaauuuuucuaucaacagcuguaucugcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6952 - RNA, 2473 nt, Artificial Sequence
  ZIKV prME variant mRNA Design 2 opt
ggggcgcugccuacggagguggcagccaucuccuucucggcaucaagcuuaccaugaaaaaaagaagaggagcagacacaaguguaggaauaguaggacuauuauuaacaacugcaauggcagcagaaguaacaagaagaggaucagcguauuauauguaucucgauagaaaugaugcaggagaggcaauauccuucccaacaacucuuggaaugaacaaaugcuauauacaaauuauggauuuaggacauaugugcgaugcaaccauguccuacgaauguccaauguuagaugaagguguagaaccugaugauguagauuguugguguaauacaacaaguacuugggugguauauggaacaugccaucauaaaaaaggagaggcaagaagaagcaggagagcgguaacacuaccaucccauagcacacgaaaacuacaaacuagaagucaaacauggcuagaaagcagagaauacacuaaacaucuuauaagaguagaaaauuggauauuuagaaacccaggguuugcgcuagcagccgcagccauugcuugguuauuaggcucaucaacaagccaaaaaguaauauaccuaguaaugauacuacuaauagcgccugcauauucaauuagaugcauuggagucuccaauagagauuuuguagaaggaaugaguggagggacaugggucgacauaguacuagaacacggagguuguguuacagugauggcgcaagauaaaccaaccgucgauauagaauuaguaacuacaacaguaucaaauauggcagaaguaagauccuauuguuaugaagcaucgauaagcgauauggccucagauucuagaugucccacacaaggagaagcuuacuuagauaaacaaucugauacacaauaugucuguaaaagaacacucguagauagaggauggggaaauggauguggccuauucggaaaagguaguuuaguaacaugugcaaaauuugcauguagcaaaaaaaugacaggaaaaagcauucaaccagaaaaucuggaauauagaauaauguuaucuguacauggaagucaacauucagggaugauaguuaaugauacaggacacgaaacagaugaaaaucgagcaaaaguugaaauaacaccuaauaguccaagagcagaagcaacauuaggaggauuuggaagucuaggauuagacugugaaccuagaacuggauuggauuuuagugacuuauauuaucuuacuaugaauaauaaacacuggcuuguucauaaagaaugguuccacgauauaccacuaccauggcaugcaggcgcugacacagguacaccccauuggaauaacaaagaagcacuaguagaauucaaagaugcucaugcaaaaagacaaacagucguaguucuaggaagucaagaaggagcaguacacacagcuuuagcuggagcauuagaagcagaaauggauggugcaaaaggacgacuaucaucaggacacuuaaaaugcagacuaaaaauggauaaauuaagacuaaaaggaguaucauauaguuuguguacagccgcauuuaccuuuacaaaaauuccagcugaaacauuacacggaacuguaacaguggaaguacaauaugcagguacagacggaccguguaagguaccagcucagauggcaguagauaugcaaacauuaacgcccguugguagauuaauaacugcaaauccagugauaacagaaucaacagagaauagcaaaaugaugcuagaauuagaucccccauuuggagauagcuauauaguaauuggaguaggagaaaaaaaaauaacacaucauuggcaucgaucaggauccacuauagguaaagcuuuugaagcaacaguaagaggggcuaaaagaauggcgguauuaggagauacagccugggauuuuggaucagucggaggugcauuaaacaguuuagguaaaggaauucaucaaauauuuggagcagcauucaaaagcuuauuuggagguaugucaugguuuucgcaaauacugauuggaacauugcuaauguggcuaggacuaaauacuaaaaauggaaguaucucauuaaugugucuagcacuaggagguguauuaauauuucucagcacagcagucucagcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6953 - RNA, 2470 nt, Artificial Sequence
  ZIKV prME variant mRNA Design 2 opt
ggggcgcugccuacggagguggcagccaucuccuucucggcaucaagcuuaccaugaaaagaagaggugcagauacaucaguaggaauaguuggguuauuacuaacaacagcaauggcagcagaaguaacgagaagggguagugcguacuauauguaccuagaccgaaaugaugcaggugaagcuauaagcuuuccaaccacacuaggcaugaauaaauguuauauacaaauaauggaucuaggacauaugugugaugcuacaaugaguuacgaauguccaaugcuagacgaaggaguagagccagacgauguagacuguugguguaauacgacaucaacauggguaguauaugguacaugucaucacaaaaaaggcgaagcaagacgaucaaggagagccgucacucuaccaagucacagcacaagaaaacuacaaacuagaagucaaacaugguuagaaucaagagaauauacaaaacaucuaauaaggguggaaaacuggauauucagaaauccagguuuugcacuagcagcagcagcgauagcuugguuauuagguaguucuacuucacaaaaaguuauauacuugguaaugauuuuauuaauagcacccgcauacaguauaaggugcauuggaguaaguaauagagauuuuguagagggaaugaguggaggaacauggguagauauaguauuagaacauggaggcuguguaacugugauggcacaagacaaaccuacaguagacauugaauuaguaacgacaacaguuucaaauauggcagaaguaagaucuuauuguuaugaagcaaguauaagcgauauggcaagugacagcagauguccaacacaaggggaagcuuaucuugacaagcaaucagacacgcaauacguuuguaaacggacauuaguagauaggggcugggggaacggauguggauuauuuggaaaaggguccuuaguaacaugcgcaaaauucgccuguaguaaaaaaaugacaggaaaaucuauacaaccagaaaaucucgaauauagaauaauguuaucaguacauggaagucaacauucagggaugauaguaaaugauacuggccaugaaacagacgaaaauagagcaaaaguagaaauaacaccuaauagucccagagcagaagcaacauuaggaggauucggaucauuaggauuagacugugaaccaagaacaggccuagauuucucugacuuauauuaccuaacaaugaauaauaaacacuggcuaguucacaaagagugguuucaugacauaccgcuaccuuggcaugcaggugcagauacaggaacgccacauuggaauaauaaagaagcacuaguagaguuuaaagaugcucaugcaaaaagacaaacgguaguaguauuaggaagccaagaaggagcaguacacacagcucuagcaggagcucuugaagcagaaauggauggugcuaaaggucgauuaucauccggacacuuaaaauguagauuaaaaauggacaaacuaagauuaaaaggaguaagcuacagccuauguacagcagcauuuacauuuacaaaaauaccagcagaaacuuuacauggaacaguaacaguugaaguacaauaugcaggaacagaugggccauguaaaguuccugcgcaaauggcaguagacaugcaaacauuaacaccaguaggaagauugauaacagcaaauccaguaauaacugaaucaacugaaaacucaaaaaugaugcuagaacuagacccaccauucggagauagcuauauaguaauuggaguuggcgaaaaaaaaauaacacaucauuggcacagaaguggaaguacgauuggaaaagcauuugaggcaacaguaagaggugcuaaaagaauggcaguacuuggagacacagcuugggauuuugguagcguaggaggagcauuaaauucacuuggaaaaggaauucaucaaauauucggagcagccuucaaaucacuauuuggaggaaugaguugguuuucacagauauuaauugggacacuucuaauguggcuaggauugaauacaaaaaaugggaguauaucuuuaaugugucuagcauuaggggguguauuaauauucuugucaacagcugugucugccgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6954 - RNA, 2467 nt, Artificial Sequence
  ZIKV prME variant mRNA Design 2 opt
ggggcgcugccuacggagguggcagccaucuccuucucggcaucaagcuuaccaugagaagaggcgcagauacaucagucggaauuguuggucuuuuguuaacuacagcaauggcagcagaaguaacaagacguggaagugcguacuacauguaccuagacagaaaugaugcaggagaagcaaucucauuuccuacuacucuggguaugaacaaaugcuauauacaaauaauggaucuaggccauaugugugaugcgacaaugucauaugaguguccaaugcuagacgaagguguugaaccugacgauguagauugcugguguaacacaacaucaacauggguaguauauggaacaugccaccauaagaaaggagaagcuagaagaucaagacgagcaguaacauuacccagucauaguacaagaaaauuacagacaagaagccaaacauggcuagaaucgagagaauauacuaaacaucuaauaagaguagaaaauuggauauuccgaaacccaggauuugccuuggcagcagcugccaucgcauggcuuuuaggaaguucgacaagccaaaaaguaauauaucuaguuaugauacuucucauagcaccagcuuauucaauaagauguaucgguguuaguaacagagauuuuguagaagguauguccggagguacuuggguugauauaguauuagaacaugguggauguguuacuguaauggcacaagauaaaccaacaguagauauagaauuaguaacaacuacaguaagcaacauggcagaaguaagaucuuauuguuaugaagcaucaauaucagauauggcaagugauaguagaugcccaacccaaggagaagcauacuuagauaaacagucagauacacaauauguauguaaacgaacuuuaguugaucgaggguggggaaacggaugugguuuauuuggaaaaggaaguuuaguaacaugugcuaaauuugcaugcucaaagaaaaugacaggaaaaucaauacaaccagaaaauuuagaauauaggauaaugcuuagcguacauggaucacaacauuccggaaugauuguaaaugacacgggacaugaaacugaugaaaacagagcuaaagucgaaauaacaccuaauaguccucgagcagaagcaacauuaggaggauuugguagcuuaggacuugacugugaaccuagaacaggacuagauuuuagugaucuauacuaccuuaccaugaauaauaaacauuggcuaguacacaaagaaugguuucaugacauaccauuaccauggcaugccggagcagacacagguacaccucacuggaauaauaaagaagcccuaguagaauuuaaagaugcacacgcaaaacgacaaacagugguggucuuaggaagccaagaaggagcaguacauacagcauuagccggugcucuagaagcagaaauggauggugcaaaaggaagacuuagcucaggacauuuaaaauguagguuaaaaauggauaaauuaagguuaaaaggaguaucauauagucuaugcacagcagcauuuacuuucacaaaaauacccgccgaaacgcuacacggaacaguaacaguagaaguacaauacgcaggaacugaugguccauguaaaguaccagcucaaauggcaguagacaugcaaacauuaacaccaguagguagguuaauaaccgcgaauccaguaauaacugaaucaacagaaaauagcaaaaugauguuagaacuagacccuccauucggagauagcuauauaguaauagguguaggagagaagaaaaucacacaucauuggcauagaaguggaucaacaauaggaaaagcauuugaagcuacaguaagaggagcaaaacguauggcaguauugggagauacugcaugggauuuuggaaguguagggggagcucuaaauucacuuggcaaaggaauacaucaaauauuuggagcagcauuuaaauccuuauucggaggaaugucuugguuuagccaaauacuaauaggaacuuuauuaauguggcuuggacuaaacacuaaaaauggaucaauuucuuuaaugugucuagcucuaggaggaguacuuaucuuucuaaguacagcagugagugcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6955 - RNA, 2464 nt, Artificial Sequence
  ZIKV prME variant mRNA Design 2 opt
ggggcgcugccuacggagguggcagccaucuccuucucggcaucaagcuuaccaugagaggagcagacacaaguguagguauaguuggauuauuauuaacaacagcaauggcagccgaaguaacaagaagagguucagcuuauuauauguauuuagacagaaaugaugcaggagaagcaauaucauucccaaccacgcuuggaaugaauaaaugcuauauacaaauaauggauuuaggacacaugugugaugcaacaaugucauaugaaugccccauguuagaugaagguguagaaccagaugacguagacuguugguguaauacaacgagcacaugggucguauauggaacuugccaucauaagaaaggagaagcuagacgaagcagacgagcaguaacgcuaccaagucacucaaccagaaaauugcaaacaaggagucaaacauggcuagaaucaagagaauauacuaaacaucuuaucagaguagaaaauuggauuuuucgaaauccaggauuugcacuugcugcagcugcuauagcauggcuauuagguucaagcaccucacaaaaaguaauauaucuaguuaugauacuauuaauugccccugcauacucaauuagauguauaggaguaucaaauagagacuucguagagggaaugucaggaggaacuuggguagauauaguacuagaacaugguggauguguaacaguaauggcacaagauaaaccaacuguugacauagaauuaguaacaacaaccguaaguaauauggcagaaguaagauccuacugcuaugaggcaaguauaagcgauauggcaucagauagucgauguccaacacaaggggaagcauauuuagauaaacaaucagauacgcaauacgucuguaaaagaacauuaguggacagaggaugggguaaugguuguggacuauucggaaaagguagcuuaguuacaugugcaaaauuugcauguaguaagaaaaugacaggaaaaucaauucaacccgaaaacuuagaauauagaauaaugcuaucaguacauggaagucaacauucagguaugauuguaaacgauaccggccaugaaaccgaugaaaauagagcuaaaguagaaauaacgccuaauagcccaagagcggaagcaacacugggaggauuugggagcuuaggauuggauugugaaccaagaacaggacuagauuucucugacuuauauuaccuaaccaugaauaauaaacauugguuaguacauaaagaaugguuucaugauauaccacuaccguggcaugcaggggcagauaccggaaccccacacuggaauaauaaagaagccuuaguagaauuuaaagacgcgcaugcaaaaagacaaacuguaguaguauuaggaucacaagaaggggcaguucacaccgccuuagcaggagcacuagaagcagaaauggauggagcuaaaggucgacuaucaucaggacauuuaaaauguagacuuaaaauggauaaauuaagauuaaaaggaguuaguuacucauuaugcacugcagcauucacuuucaccaaaauaccagcagaaacauuacauggcacuguaacaguagagguacaauaugccggaacagauggacccugcaaaguaccagcgcagauggcugucgauaugcaaacauuaacuccaguuggucgacucauaacugcuaaucccguaauaacagaaucaacagaaaauucaaaaaugaugcuugaauuagauccucccuuuggagauucauauauaguaauaggaguaggggaaaagaaaauaacccaccauuggcauagaaguggaaguacaauugguaaagcauuugaagcaacaguuagaggagcaaaaagaauggcgguauuaggagauacagcgugggacuucggcagcguaggaggcgccuuaaauucuuuaggaaaagggauacaucaaauauuuggagcagcauucaaaucauuauucggaggaaugucaugguuuucacaaaucuuaauaggaacucuauuaaugugguuaggucuaaauacuaaaaacggcucaauaaguuuaauguguuuggcacuaggcggaguacuaauuuuccuaucgacagcaguauccgcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6956 - RNA, 2461 nt, Artificial Sequence
  ZIKV prME variant mRNA Design 2 opt
ggggcgcugccuacggagguggcagccaucuccuucucggcaucaagcuuaccaugggagcggauacaucaguugguauaguaggacuguuauuaacaacagcuauggcugcagaaguaaccagaagaggaucagcauauuauauguauuuagauagaaaugaugcuggagaagcuauaucauuucccaccaccuuaggaaugaauaaauguuacauucaaauaauggauuugggacacaugugcgaugcaacaaugagcuaugagugucccauguuagacgaaggaguugaaccagaugacguagauuguugguguaauacgacaaguacuuggguaguauacggcacaugucaucacaagaaaggagaagcacgccgcucaagacgagcuguaacccuucccagucauaguacaaggaaauugcaaacucguagccaaacaugguuagaauccagagaauauaccaaacaucucauaagaguagaaaacuggauauuuagaaauccaggauucgcauuagcugcagcagcaauagcauggcuccuaggaucaagcacaucccaaaaaguuauauaccuaguuaugauauuauuaauagcuccagcauauucaauuagauguauaggaguuucaaaccgugacuuuguugaaggcaugucaggaggaacauggguagauauaguacuagaacacggaggauguguaacuguaauggcacaagacaaacccacaguugauauagagcuaguuacuacaacaguaaguaauauggcagaaguaagaaguuauugcuacgaagcaucaauaagugauauggcaagugacaguagaugcccaacccaaggagaagcguacuuagacaaacaaagugauacccaauauguuuguaaaagaacacuuguugaucgaggauggggaaauggaugcggacucuuugguaaaggaucauuaguaacaugugcaaaauuugccuguagcaagaaaaugacaggaaaaucaauacaaccagaaaaccuagaauauagaauaauguuaucuguacaugguucacaacauucagguaugauugucaacgacacaggacaugaaacugaugaaaauagagcaaaagucgaaauaacuccaaauucaccacgagcagaagccacuuuaggggguuuuggaagucuaggauuagacugugaaccaaggacaggauuagauuuuucagaucuauauuauuuaacaaugaacaacaaacauuggcuaguacacaaagaaugguuucaugacauaccauuacccuggcacgcaggcgcugacacuggaacuccgcacuggaauaauaaagaagcccuaguugaguucaaagacgcacaugcaaaaagacaaacaguaguuguauuaggaucacaagaaggagcuguacauacagcauuggccggagcauuagaagcugaaauggauggagcaaaagguagacuaagcagcggccaucucaaaugcagauuaaaaauggacaaacuaagacuaaaaggcguuucauacucacuauguacagcagcuuuuacauuuacuaaaauaccugcagaaacauuacaugguacaguaacaguugaaguacaauaugcaggaacagauggaccaugcaaaguaccagcacaaauggcagucgauaugcagacauuaacgccaguaggacgacuaauaacagcaaauccuguaauaacagaaagcacagaaaauucaaaaaugaugcuagaacucgacccucccuucggggauucauauauaguaauaggaguaggcgaaaagaaaauaacacaccauuggcaucguucaggaaguacuauaggaaaagcauucgaagccacaguaagaggugcaaaaaggauggcaguguuaggagauacagcaugggauuuuggaucagucggaggagcacuaaauagcuuaggaaaaggaauacaucagauauuuggagcagcauuuaaaaguuuauucgguggaaugucuugguucucucaaauuuuaauaggaaccuuacuuaugugguuggggcuaaauaccaaaaauggaucaauaucauuaaugugcuuagcucuaggagguguacuaauauuucuaucgacagcaguguccgcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6957 - RNA, 2458 nt, Artificial Sequence
  ZIKV prME variant mRNA Design 2 opt
ggggcgcugccuacggagguggcagccaucuccuucucggcaucaagcuuaccauggcugauacaucaguaggcauaguaggucuacuuuuaacaacagcaauggcagcugaaguaacaaggcgagguagcgcuuauuacauguacuuagauagaaaugaugcaggggaagcuauaucuuuuccgacaacauuaggaaugaauaaaugcuauauucaaauaauggaccugggacauaugugugaugcgacaaugaguuaugaaugcccaauguuagaugaaggaguugaaccggaugacguagacugcugguguaauacaacaaguacaugggucguauaugguacaugucaucauaaaaaaggagaagcaagaagaucaagaagagcaguuacauuaccuucacacucuacaagaaaauugcaaacacgaagccaaacguggcuugaaucaagagaguacacaaaacauuuaauccgaguagaaaauuggauuuucagaaauccaggauucgcacuagccgcagcagcaauagcaugguuacucggaucaaguacaucacaaaaaguaauuuacuuaguaaugauauuacuaauagccccagcauauaguauaagauguauaggaguaaguaauagagauuuuguggaaggaaugaguggagguacguggguagauauuguauuagaacaugguggauguguaacaguaauggcacaggauaaaccaacaguagacauugaauuaguaacaacaaccguaucaaacauggcagaaguaagaucauacuguuaugaagcaaguauaucugauauggcgagcgacucaagauguccuacacaaggugaagcguaucuagauaaacaauccgauacucaauauguauguaaaagaacccuaguagacagaggguggggcaaugguugugguuuauuuggcaaaggaucauugguaacaugugcaaaauucgcaugcucaaaaaaaaugacuggaaaaucaauucagccggaaaaccuagaauauagaauaauguuaucuguucacggaagucaacacucaggaaugauuguaaacgauacuggucacgaaacugaugaaaauagagcuaaaguagaaauaacaccaaauaguccaagagcagaagccacccuugguggauucggaagucuaggauuagauugcgaaccaaggaccggauuagacuucucagauuuauauuaucuaacuaugaauaauaaacauuggcuaguacacaaagaaugguuucacgauauaccuuuaccauggcaugcaggagcagauaccgguacaccacacuggaacaauaaagaagcuuuaguagaauuuaaagaugcucacgcaaaacgacaaacgguuguaguacuaggaucacaagaaggagcaguccacacagcauuagcgggagccuuagaagcagaaauggauggagcaaaaggaagacuuaguucaggacauuuaaaaugccgauuaaaaauggauaagcuuagacuaaaaggaguaaguuacagccugugcacagcugcauuuacauuuacaaaaaucccagcggaaacauuacauggaaccgucacaguagaaguacaauacgccggaacagauggcccaugcaaaguaccagcucaaauggcuguagauaugcaaacacuaacaccaguaggaagacuaauaacagccaacccaguaauaaccgagucuacagaaaacaguaaaaugauguuagaacucgauccuccauuuggagauagcuauauaguaauugguguaggagaaaaaaaaauaacacaucauuggcaucgaucagguucaacaauagguaaagcauuugaagcuacaguacgaggagccaaaagaauggcaguauugggugauacagcaugggauuuuggaucugucggaggagcauuaaacucauuaggaaaagguauacaucaaauauuuggugcugcauucaaaagcuuauuuggaggaaugucaugguuuucccaaauucuaauaggaacauuauuaaugugguuaggauuaaacacgaaaaaugggucaauaagucuaaugugccuugcauuagguggaguacuaauauuucuaagcacugcaguaucagcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6958 - RNA, 2455 nt, Artificial Sequence
  ZIKV prME variant mRNA Design 2 opt
ggggcgcugccuacggagguggcagccaucuccuucucggcaucaagcuuaccauggacacaaguguaggaauaguaggauuguuauuaacaacugcaauggcagcagaagucacucgucgugguagcgcauacuauauguauuuagauagaaaugaugcaggagaagcaauaucuuuuccgacaacauuaggaaugaacaaauguuauauacaaauaauggauuuaggucauaugugugacgcuacgaugucauaugaauguccaauguuggaugaaggaguagaaccagaugacgucgauuguuggugcaauacgacauccacauggguaguuuaugggacaugucaucauaagaaaggagaagcgaggagaagcaggagagcaguaaccuuaccaagucacagcacaagaaaacuacaaacaagaagucaaacaugguuagaaucaagagaauauaccaaacacuuaauaaggguggaaaauuggauauuucgaaauccaggauuugcauuagcagcagcugcaaucgcgugguuauuaggaucaucaacaucacagaaaguaauauaccuaguuaugauauuauuaauagcaccagcauauagcauaagaugcauaggagugaguaauagagauuuuguagaaggaaugaguggaggcaccuggguagauauaguacuagaacauggcggaugugucaccguuauggcucaagauaaaccaacaguagauauagaauuaguaacuacaacaguaucaaauauggcagaaguaagaaguuacugcuaugaggcuucaauaagugacauggcuucagauucaagauguccgacacaaggagaagcauauuuagauaaacagucugauacucaauauguaugcaaaagaacccuaguagacagaggauggggaaaugguugugguuuauucggaaaaggaagucugguuacaugugcaaaauucgcaugcucuaagaaaaugacaggaaaaucaauccaaccagaaaaccuagaauacagaauaauguuaucaguacacggcucacaacauaguggaaugauagugaaugauacuggacacgaaacugaugaaaaucgagcaaaaguagaaauaacacccaacaguccgagagcagaagcuacauuaggaggauuugguucauuaggauuggauugcgaaccaagaacagguuuagacuuuagugauuuauauuaucuuaccaugaauaacaaacauuggcuuguacauaaagaaugguuucaugacauuccucuaccauggcaugccggagcagauacggguacuccacacuggaauaauaaagaagcauugguagaauuuaaagaugcacaugcaaaaagacaaacuguaguaguauuaggaagucaagaaggagcaguucauacugcguuagcuggagcauuagaagccgaaauggauggagcaaagggaagauuaucaaguggacaccuuaaaugccgacugaaaauggauaaacuaagacuuaaagguguuucuuauucuuuauguacugcggcuuucacauuuacgaaaauacccgcugaaacacuucaugguacuguaacaguagaaguacaauaugcaggaacagacggaccauguaaaguaccagcacaaauggcagucgauaugcaaacacuuacaccaguagguagacuuaucacagcgaauccaguuauaacugaaaguacagaaaauaguaaaaugaugcuggaauuagauccuccuuucggagacaguuacauaguuauugguguaggggaaaagaaaauaacacaucacuggcauagaaguggaucaacuauaggaaaagcauuugaagcaacaguccguggagcaaaacgaauggcaguacuaggcgauacugcaugggauuuugguagcguugguggagcacuaaauucacuuggaaaaggaauacaccaaauauuuggagcagcauuuaaaucacuuuuugguggcaugucaugguuuucacaaauuuuaauuggaacauuauuaauguggcuaggauuaaauacuaaaaacgguaguauaucguuaaugugucuagcacuagguggagucuuaauauuucuuaguacagcaguuagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6959 - RNA, 2452 nt, Artificial Sequence
  ZIKV prME variant mRNA Design 2 opt
ggggcgcugccuacggagguggcagccaucuccuucucggcaucaagcuuaccaugacaagugucggaauaguaggauuauuguuaacaacggcaauggccgcagaagugacgagaagggggucugcuuauuauauguaucuugauagaaaugaugcaggagaagcuauaaguuuuccaacaacucuaggaaugaauaaauguuacauucagauaauggacuuagggcauaugugcgaugcaacaaugucauacgagugcccaaugcuagaugaaggaguagaaccagaugacguugacugcugguguaauacaacuucaacauggguagucuacgguacaugucaucacaaaaaaggagaagcaagaagaucuagaagggcagugacauuaccuagucauagcacgaggaaacuccaaacccgaucacaaacauggcuagaaagcagagaauauacaaagcaccuaauaagaguagaaaauuggauuuuuagaaauccaggauucgcauuagcagccgcugcgauugcaugguuacuuggaucaaguacgucgcaaaaaguuauauacuuaguaaugauauugcuaaucgcaccagcauauucgaucagaugcauaggaguaucaaacagagacuucguagaaggaaugaguggaggaacauggguagauauaguacuagaacauggagguugugugacaguaauggcacaagauaaaccaacuguggacauagaacuagugacaacaacaguaucaaacauggcagaaguacgaucuuacuguuaugaagcgucaauaagcgauauggcaagcgauaguagaugcccaacacaaggagaagcauacuuagauaaacaaucagauacucaauauguauguaaacgaacacuaguagauagaggauggggaaauggauguggauuauuuggcaaaggaagucugguaacuugugcaaaauuugcuugcaguaaaaaaaugacaggaaaaaguauacaaccagaaaaccuugaauauaggauuauguuaaguguucacgggagucaacauagugggaugauugucaaugauacaggacaugaaacagacgaaaauagagcaaaagucgaaauaacgccaaacaguccaagagcugaagcgacauuaggaggauuuggaucauuaggacuagauugugaaccaagaacugggcuagacuuuucagacuuauacuaucuaacaaugaauaauaagcacugguuaguucauaaagaaugguuucaugacauaccacuaccuuggcaugcaggagcagauacuggaacuccgcauuggaauaauaaagaagcauuaguagaauucaaagaugcacaugcaaaacgacagacaguagucguacuuggaagucaagaaggagcggugcauacagccuuagcaggagcauuagaagcagagauggacggcgcuaaagguagacuuagcagcggacaucuaaaauguagacuaaaaauggauaaacuaagacuaaaaggaguaucauauucauuauguaccgcagcguucacauuuacaaaaauaccagcggaaacauuacauggaacuguaacaguagaaguacaauaugcaggaacugauggaccauguaaaguaccagcacaaauggcaguagauaugcaaacauuaacacccguaggaagacuaauaacagcaaauccaguaauaacagaaaguacagaaaauucuaaaaugauguuggaauuagacccaccuuuuggagacaguuacauaguaauaggaguaggagaaaaaaaaauaacacaccauuggcauaggaguggaagcaccauaggaaaagcauuugaagcuacuguaagaggagcgaaacgaauggcuguucuaggagauacggcuugggacuuuggaaguguaggaggagcguuaaauagucucggcaaaggaauucaucaaauauucggagcagcauuuaaaucacuauuugguggaaugucaugguuuagucaaauauugauaggaacacuauuaaugugguuaggauuaaauacuaaaaacggcaguauaucacuaaugugcuuagcauuagguggaguuuuaauauuccuaaguacagcaguaagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6960 - RNA, 2452 nt, Artificial Sequence
  ZIKV prME variant mRNA Design 2 opt
ggggcgcugccuacggagguggcagccaucuccuucucggcaucaagcuuaccaugacaucaguaggaauuguugguuuacuauuaacaacagcaauggcagccgcaguaacacgccgaggcucggcuuacuauauguauuuagauagaaacgaugcaggagaagcaauaucauuuccaaccacacuggguaugaauaaaugcuauauccaaauaauggaucuaggacauaugugcgacgcaacaaugucauaugaauguccaaugcuagaugaaggagucgaaccagaugauguagauugcugguguaauaccacaaguaccuggguaguauauggcacaugucaucauaagaaaggcgaagcaagaagaaguagacgagcaguaacauuaccaucacauucaacaagaaaacuucaaacaagaagccaaacuuggcuagaaagcagagaauauacaaaacauuuaauaagaguggaaaauuggauauucagaaauccuggcuuugcauuagcugcagcggcuauagcuugguuacuuggaucuaguacuucacagaaaguaauauaucuaguaaugauacuauuaauagcaccagcuuacaguauccgaugcauaggaguaucgaacagagauuuuguagaagggaugucagguggaacauggguagauauaguauuagaacacggcggaugcguaacaguaauggcacaagacaaaccaacaguagacauagaacuuguaacaacaacaguaucaaauauggcagaaguuagaucauacugcuaugaagcaucaauaucagacauggcuucagauaguagauguccaacacaaggagaagccuacuuagauaaacaguccgauacucaauauguauguaaaagaacccuaguagaccgcgguuggggaaaugguugcggacuauucggaaaaggaagucuaguaaccugugcaaaauuugcauguaguaagaaaaugaccggaaaaaguauucaaccagaaaauuuagaauauagaauaauguuaaguguacauggcucucaacauucaggaaugauagucaaugauacaggucaugaaacagaugaaaauagagcuaaagucgaaauaacaccaaauucaccacgugcugaagcaacacuaggaggauuuggaucacucggauuagauugugaaccaaggacaggcuuggauuucucagauuuauauuaucuaacuaugaacaacaaacauugguuaguccauaaagaaugguuucacgauauaccucuaccauggcaugcuggugcagauacaggaacaccccauuggaauaauaaagaagcucuagucgaauuuaaagaugcacacgcaaaacgccagacaguaguuguacuaggaagccaagaaggagcaguacacacagcucuagcaggagcuuuagaagcagaaauggauggugcaaaaggaagacuaagcucaggacaucugaaaugcaggcuaaaaauggauaaauuaagauuaaaaggaguaagcuauucauuauguacagcagcauuuacauucacaaagauaccagcggaaacauuacacgggaccguaaccguagaaguacaauaugcagguacagacggaccauguaaaguaccagcacaaauggcaguagacaugcaaaccuuaacaccaguaggucgauuaauaacagccaauccaguaauaacagaaucaaccgaaaauuccaaaaugaugcuagaauuagauccaccuuucggagauaguuauauaguaauaggaguaggagaaaagaaaaucacacaucacuggcauagaucuggcuccacuauaggaaaagcauuugaagcuaccguuagaggagcaaaaagaauggcugucuuaggagauacugcaugggacuuuggaaguguuggaggugcacuuaacagccuaggaaaaggaauacaucaaauauucggugcagcuuuuaaaagucucuucgguggaauguccugguucucucaaauuuuaauagguacacuacuuauguggcuuggucuaaacaccaaaaauggaucaauaucauuaaugugccuggcacuaggaggaguacuaauauucuuaucaacagcuguaagcgcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6961 - RNA, 2464 nt, Artificial Sequence
  ZIKV prME variant mRNA Design 2 opt
ggggcgcugccuacggagguggcagccaucuccuucucggcaucaagcuuaccaugagaggagcagauacaaguguugguauaguaggcuuacuauuaacaacagcaauggccgcugcuguaacacgaagaggaagugcauauuacauguacuuagaccgaaacgaugcaggagaagccauaucauuuccaacaacguuaggaaugaacaaaugcuacauacagauaauggaucuaggacauaugugugacgcaacgaugucauacgaauguccaauguuagaugaaggcguagaaccagaugauguagauuguuggugcaacacaacaaguacauggguaguauauggcacaugucaccauaaaaaaggggaagccagaagaagcagaagagcgguaacacuaccuucacauaguacuagaaaacuucaaacgcgcucucaaacauggcuugagaguagagaguauacaaaacauuuaauuagaguagaaaauuggauauuucgaaaucccgguuuugcauuagcagcagcagcaauagcauggcugcucggaucaucaacuucacaaaaaguuauauauuuaguaaugauauuacuaauagcaccagcauacagcauacgaugcauaggaguuucaaacagagauuuuguagaaggaaugucuggaggaaccuggguagacauugugcuugagcauggaggaugcguaacuguuauggcacaggacaaaccaacgguugauaucgaauuaguuacaacuacaguaucaaauauggcggagguuagauccuauuguuaugaggcaucuauaucagauauggcaucagauucgagauguccuacucaaggugaagcuuaucuagacaaacaaagugacacgcaauauguuuguaaaagaacuuuaguugacagaggauggggaaauggcugugguuuauuuggaaaagggaguuuaguaacaugugcaaaauuugccuguucuaaaaaaaugacaggcaaaucaauacaaccagaaaauuuagaauauagaauaauguuaucaguacauggaagucaacauagcggaaugauaguuaaugauacaggacacgaaaccgaugaaaaccgugcuaaaguugaaauaacaccaaauucaccaagagcagaagcaacauuaggaggauucggauccuuaggacuugacugugaaccaagaacaggacuagacuuuagugacuuauauuauuugacaaugaauaauaaacauugguuaguacauaaagaaugguuucacgauauaccauuaccuuggcacgcaggagcagauacaggcacaccacauuggaauaacaaagaagcuuuaguagaauucaaagacgcacacgcaaaacgacaaacuguugucguacuaggaucacaagagggugcaguacacacagcgcuagcuggagcauuagaagcagaaauggacggagcuaaaggacgcuuaucaucagggcaccuaaaaugucgacuaaaaauggauaaacuaagguuaaaaggaguauccuauucccuauguacagcagcauucacauucacaaaaauaccagcagaaacauuacacggaacaguuacuguggaaguacaauaugcaggaacagauggaccauguaaaguuccagcucaaauggccguagacaugcaaacguuaacaccaguaggaagacuuauuacagcgaacccaguuauaacagaaaguacugaaaauaguaaaaugauguuggaauuagauccuccauuuggagauucuuauauaguaaucggcguaggggaaaaaaagauaacacaucauuggcacagaagcggaucuacaaucggaaaagcauuugaagcaacaguaagaggcgcaaaaagaauggcaguacuaggagauaccgcaugggauuuugguaguguaggaggagcacuaaauagccuaggaaaaggaauacaccaaauauucggggcagcauucaaaagcuuauuugguggaaugucaugguucagccaaauacuaauaggaacauuauuaauguggcuuggacucaacaccaaaaauggaucuauuagccuaaugugcuuagcguuaggaggaguacuaauauucuuaucaacagcaguaagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6962 - RNA, 2488 nt, Artificial Sequence
  ZIKV prME variant mRNA Design 2 opt
ggggcgcugccuacggagguggcagccaucuccuucucggcaucaagcuuaccaugcgaggauuaucaucaaggaaacgaagaagccaugacgucuuaacuguacaauucuuaauacuaggaaugcuauuaaugacaggcgguguaacaagaagaggaagugcauacuacauguaucuugacagaaacgaugcgggugaagccauaagcuuuccaacaaccuuaggaaugaauaaauguuacauacaaauuauggacuuagggcauaugugcgaugcaacaaugaguuaugaauguccuaugcuagaugagggaguagaaccugacgauguagacuguuggugcaacacaacaucaacuugggucguuuaugggacuugucaccauaaaaaaggugaggcaagaagaaguagaagagcaguaacauuaccuucacauuccacaagaaaauugcaaacacgaucacaaacaugguuagaaaguagagaauacacaaaacaccuuauaagagucgaaaauuggauauuucgaaauccaggcuuugccuuggcugcugcagcaauugccuggcuauuagguaguucuacuagucaaaaagugauauauuuagugaugauuuuauugauagcaccggcauauagcauaagauguauuggcguaaguaauagagauuuuguugaagguaugaguggugguaccuggguagauauaguccuagaacauggaggauguguaacaguaauggcacaagauaaaccaacaguagauaucgaacuaguaacuacaacugucucaaacauggcagagguuagaaguuauuguuacgaagcaaguauaagugauauggcaagcgauucucgauguccaacacaaggugaagcuuacuuagauaaacaaucagauacacaauauguauguaaaagaacacuaguugacagaggaugggguaauggauguggacuauuuggaaaaggauccuuagucacuugcgcuaaauuugccuguagcaaaaaaaugacggguaaaucaauacaacccgaaaauuuagaauaccgaauuauguugaguguucauggaucucaacauucagguaugauuguaaaugauacaggacaugaaacagaugaaaaccgagcaaaaguagaaaucacuccaaacagcccuagagcagaggcaacccuuggaggauucggaaguuuaggccuagauugugaaccaagaacaggauuagauuuuagugacuuauacuaccuaacaaugaauaauaaacauugguuaguacauaaagaaugguuucaugauauacccuuaccuuggcaugcuggagcagacacaggaacgccacauuggaauaacaaagaagcacuaguugaauuuaaagaugcacaugcaaaaagacaaacaguaguaguauuaggaagucaagagggagcagugcacacagcuuuagcaggcgcacuagaagcugaaauggacggugcaaaagguagacuaucaaguggacacuuaaaauguagacuaaaaauggacaaauuaagauuaaaaggggugucauauucuuuauguacagcugcauuuacauucacuaaaauuccagcagaaacacuacauggaacaguaacaguggaaguacaauaugcaggaacagauggaccaugcaaagugccugcacaaauggcaguagauaugcaaaccuuaaccccaguaggaagauuaauaacggcaaacccgguaauaaccgaaucaacugaaaacaguaaaaugauguuggaacuagauccaccauuuggagauucauauauaguuauaggagugggagaaaaaaaaauaacccaucauuggcauagaaguggaagcacaauaggaaaggcauucgaagcuacagucagaggagcaaaaagaauggcuguucuuggagauacagcaugggauuuugguaguguugguggagcuuuaaauagccuuggaaaaggaauucaucaaauauuuggagcagcauucaaaagcuuauuuggaggaaugucuugguuuucacaaauauugauaggaacacuuuuaaugugguuaggauugaacacaaagaacggaaguauaucuuuaauguguuuagcauuaggugguguucuaauuuuucuaucaaccgcaguaagugcagauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6963 - RNA, 2488 nt, Artificial Sequence
  ZIKV prME variant mRNA Design 2 opt
ggggcgcugccuacggagguggcagccaucuccuucucggcaucaagcuuaccaugagaggauugaguaguagaaaacgacgaagucacgauguucuaacaguacaauuucuaauuuuagguaugcuauugaugacaggagcaguaacaagacgaggaucagcauauuauauguauuuagauagaaaugaugcaggagaagcaauaaguuuuccaacuacuuuaggaaugaacaaauguuauauucaaauaauggauuuaggccauaugugugaugcuacaaugaguuaugaaugcccaauguuagacgaaggaguagaaccagacgacguagauuguugguguaauacaacaucaacauggguaguguauggcacaugucaucacaagaaaggagaagcgagaagaaguagacgagcaguuacacuaccaagucauagcacgagaaaauuacaaacaagaucacagaccugguuagaaucaagagaauacacuaaacaccugauaagaguagaaaauuggauuuuuagaaaucccggauuugcacuagcagcugcagcuauagcuuggcuauuagguaguuccacuagccaaaaaguaauuuaccuaguaaugauauuacuaauagcaccagcauauaguauaagaugcauaggagugucaaauagagauuuuguagaaggaaugagcggugguacauggguggauauagucuuagaacauggaggauguguaaccguaauggcacaagacaaaccaacaguugauaucgaacuuguaacaacaacgguaucaaauauggcugaaguaagaucauacuguuaugaagcaaguauaucagauauggcaagugacucaagaugcccaacacaaggagaagcauaucuagauaaacaaucagacacacaauaugugugcaaaagaacauuaguagacagaggauggggaaauggauguggacuauucggaaaagggagcuuaguaacaugcgcuaaauucgcgugcaguaagaaaaugacaggaaaaaguauacaaccagaaaauuuagaauauagaauaaugcuaucaguacacggaucgcaacauucagguaugauaguaaacgauacaggacaugaaacagaugaaaaccgagcuaaaguggaaauaacgccaaauucacccagagccgaagcaacauuaggggguuucggaaguuugggauuggauugcgaaccuagaacgggguuagauuuuucagauuuauauuaccuaacaaugaauaauaaacauuggcucguacacaaagaaugguuucaugauauaccuuuaccauggcaugcaggagccgauacugguacuccacauuggaauaauaaagaagcccuaguagaauuuaaggaugcucacgcaaaaagacaaacaguugugguucuaggaagucaagaaggagcgguacauacagcauuagcaggcgcauuagaagcugaaauggauggagcgaaaggucgacugaguucaggacaucuaaaauguagauuaaagauggauaaacuaagacuaaaaggaguaucauauucauuauguacugcagcuuuuacguuuaccaagauuccagcagaaacacuacauggaacuguuacaguagaaguucaauaugcuggaacagacggaccaugcaaaguacccgcacagauggcuguagacaugcagacauuaaccccaguaggacgacuaauaacggcuaacccagucaucacugaaucaacugaaaauucgaaaaugaugcuagaacuagacccaccuuuuggagacaguuauauaguuauuggaguuggagaaaagaaaauaacacaucacuggcauagaagcggaaguacaauagguaaagcauuugaagcaacaguacgcggugcaaaaagaauggcaguuuuaggagauacugcaugggauuucggaucuguagguggagcacuaaacucucuuggaaaagguauucaucaaauauuuggagccgcuuuuaaaaguuuguuuggaggaaugagcugguuuucacagauauuaaucggaaccuuacuaauguggcuaggucuaaauaccaaaaauggaucaauaaguuuaauguguuuagcacuuggaggaguauuaauauuccugagcacagcaguaagugcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6964 - RNA, 2494 nt, Artificial Sequence
  ZIKV prME variant mRNA Design 2 opt
ggggcgcugccuacggagguggcagccaucuccuucucggcaucaagcuuaccaugcgaauaauaaacgccagaaaagaaaaaaagagaagaggggcagauacaucuguggguaucguaggauuauuacuuacaaccgcuauggcggcggaaguaacaagaagaggaucagccuacuauauguaccuagacagaaaugaugcuggugaagcaauaucuuucccuacaacuuuaggaaugaauaaauguuacauccaaauaauggacuuaggacauaugugcgaugcaacuaugucguaugaauguccuauguuagaugaaggaguagaaccggaugacguugauugcugguguaacacaacaagcaccuggguaguauacgggacaugccaucauaaaaaaggggaagcaagacgaagccgaagagcuguuacuuuaccaagucauucaacgagaaaacuucaaacgagaucucaaacauggcuugaauccagagaauauacaaaacauuuaaucaggguagaaaacuggauuuuuagaaauccaggauucgcauuagcagccgcggcgauagcauggcugcuagggucaagcacaucucaaaaaguaauauaucuaguaaugauacuauuaauagccccagcauauucaauaagauguauaggaguaaguaacagagauuuuguagaaggaaugucugguggaaccuggguagauauaguauuagaacauggaggauguguaacugucauggcacaagauaaacccaccguagacauagaacugguaacaacaacaguaucaaauauggcugaaguacguaguuauugcuaugaagcaucaauaucagauauggccucagauucacgauguccuacccaaggagaagccuacuuagauaaacaauccgacacacaauacguguguaaaagaacauuagucgauagaggcuggggaaauggcuguggauuauuuggaaaaggaucacuaguaacaugugcaaaauucgcgugcucaaaaaaaaugacaggaaaauccauucaaccugaaaacuuagaauauagaauuauguuaaguguacacgggucacaacauagcggaaugauaguaaacgacacaggacaugaaacagacgagaacagagccaaaguagaaauaacaccaaauagcccaagagcugaagcaacacuagguggauucggaaguuuaggauuagacugugagccacgaacugguuuagacuucagcgaucuguacuauuuaacaaugaacaauaaacacuggcuaguacauaaagaaugguuccaugauauaccauugccauggcaugcaggagcagauacaggaacaccacauuggaauaauaaagaagcauuaguagaauuuaaagaugcacacgcaaaaagacagacgguaguaguuuuaggaucacaagaaggagcuguccauacagcucucgcgggcgcacuugaagcugaaauggacggagcgaaaggcagacuaucauccggucacuuaaaauguagacuaaaaauggauaaacuaagacuuaaaggaguaucauauucauuauguacugcugcauuuacauuuacuaaaauaccagcagaaacacuucauggaacgguaacuguagaaguacaauaugcugggacagauggaccaugcaaaguaccagcacaaauggcaguugacaugcaaacauugacaccaguuggaagauuaauuacagcaaauccuguaauaacagaaagcacagagaauucaaaaaugauguuagaauuagauccaccguucggagauagcuauauaguaauuggaguaggagaaaaaaaaauaacacaucauuggcacagaucaggaucaacuauaggcaaagcuuuugaagcaacaguuaggggcgcaaaaaggauggcaguauuaggagauacagcaugggacuuuggaagcguaggaggugccuuaaauagucuuggaaaaggaauacaucaaauuuuuggagcagcauuuaaaagucuauuugguggaaugaguugguuuagucaaauucuaauaggaacucuauuaauguggcuaggacuaaauacaaaaaacgggucaauaucauugaugugucuugcauuaggaggagugcuaauauucuuaaguacagccguaagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6965 - RNA, 2488 nt, Artificial Sequence
  ZIKV prME variant mRNA Design 2 opt
ggggcgcugccuacggagguggcagccaucuccuucucggcaucaagcuuaccaugauaaacgcaagaaaggaaaaaaaaagaagaggugccgauacaucaguaggaauuguugguuuguuguuaacaacagcaauggcagcagaaguuacgagaagaggaucagcauacuacauguaucuugaccgaaacgaugcaggcgaagcaauaagcuuucccacaacauuaggaaugaauaaauguuauauucagauaauggauuuaggacauaugugcgaugcuacgaugaguuaugaaugucccaugcuagaugaaggaguugaaccagaugauguggauuguugguguaauacaacaucuacguggguaguauacggaacaugccaucauaaaaaaggcgaagcaagaagaucaagacgagcgguaacauuaccuucacauucaacuagaaaacuccaaacgagaagccagacauggcuggaaucaagagaauauacaaaacaucuuauuagaguagaaaacuggauauuucgaaauccagguuucgcuuuagcagcagcagcaauagcauggcuacuaggaucuucuacaucacaaaaaguaauauauuuaguaaugauuuuguuaauagcaccagcauacaguauaagguguauagguguaaguaauagagacuuuguagaaggaaugagcggaggaacguggguagacauaguauuagaacauggaggauguguuacaguaauggcacaggauaaaccuaccguagacauagaauuggucacaacuacagucagcaacauggcugaaguacgaaguuauugcuaugaagcuucaauuagugauauggcaucagauagcagguguccaacacaaggugaagcauauuuagauaaacaaagcgauacacaauauguauguaaaagaacauuaguagacagaggaugggggaaugguuguggacuauuugguaaaggaagcuuaguaacaugcgcuaaauuugcaugcucaaaaaaaaugacuggcaaaagcauacaaccagaaaauuuagaguaucgaauaauguuaucagugcacggaagucaacacucaggaaugaucgugaaugacacaggccaugaaacggaugaaaacagagcaaaaguagaaauaacuccaaacucaccaagagcagaagcaacacuaggaggauuuggaucauuaggacuagacugcgaaccuagaacaggacuagauuucucagauuuauacuaucuuacaaugaauaacaaacauugguuaguccauaaagaaugguuucaugauauuccauuaccauggcaugcaggagcugauacaggaacgccccauuggaauaauaaggaagcuuuaguagaauuuaaagaugcacacgcaaaaagacaaacaguaguuguauuagggagucaagagggugcaguacacacagcauuagcuggugcgcuagaagcagaaauggacggggcaaaaggaagacuuaguucuggacauuuaaaaugcagacuaaaaauggauaaauuaagauuaaaaggcguaaguuauaguuuaugcacugcugcauucacauuuacaaaaauaccagcagaaacauuacauggaacgguaacaguagaaguacaauaugcaggaacugauggaccaugcaaagugcccgcacaaauggcaguggauaugcaaacgcucacaccaguaggaagauuaauaacagcuaauccagucauaacagaaucaacugaaaauucaaagaugauguuagaauuagacccaccuuuuggagauucauacauuguaauaggaguaggagaaaaaaaaauaacacaucauuggcauagaaguggaucaacaauaggaaaagcauuugaagcaacaguacgaggggccaaaagaauggcaguacuaggagauacagcaugggacuuuggaucgguagggggagcucuaaauuccuuaggaaaaggcauacaucaaauauuuggagcggcguucaaaucuuuauuuggcgguaugucuugguucucucaaauuuuaauaggaacccuucuaaugugguuagguuuaaauacuaaaaauggaucuaucagcuuaaugugcuuagcccuaggagguguauuaauuuuuuuaucaacagcaguuucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6966 - RNA, 2491 nt, Artificial Sequence
  ZIKV prME variant mRNA Design 2 opt
ggggcgcugccuacggagguggcagccaucuccuucucggcaucaagcuuaccaugauaauaaaugcuaggaaagaaaaaaaaagacggggagcagauacaaguguaggaauaguaggauuacuacuaacaaccgccauggcagcagaagucacaagaagagguucagcauacuauauguacuuagacaggaacgaugcaggagaagccauuaguuuuccgacaacacuagguaugaacaaauguuauauacaaauaauggauuuaggacauaugugcgaugcaacaaugucauaugaaugcccaauguuagacgaaggaguagaaccagaugaugucgauuguuggugcaauacaacaucaacauggguaguauacgguacgugucaucacaaaaaaggcgaagcacguagaagucgaagagcaguaacucuaccaagccauaguacaagaaaacuacaaacucgaucacaaacgugguuagaaagcagggaauauacuaaacacuuaauaagaguagaaaacuggauauuucgaaauccagguuuugcuuuagcugcagcagcaauagcauggcuauuagggucauccacgucacaaaaaguaauauauuuaguaaugauauuacuaauagcaccagcguacuccauaagauguauaggaguuagcaauagagacuucguugaaggaaugucugguggaacauggguugauauaguccuugaacacggaggauguguaacggucauggcacaagauaaaccaacuguugauauagaacuaguaaccacaacaguaagcaauauggcagaagucagaucauauuguuacgaagccaguauaagcgauauggcaucagauucaagauguccaacucagggugaagcauauuuggauaaacaaucagauacacaauaugucugcaaacgcaccuuaguagauagagggugggguaaugguuguggacuauuuggaaaaggaucacuaguaacaugcgcaaaauucgcauguucaaaaaaaaugacagggaaauccauacaaccagaaaauuuagaauacagaauaaugcuaucaguccauggaucacaacauagugguaugauuguuaaugauacaggucacgaaacagaugaaaauagagcaaaaguagaaauaacaccaaauaguccaagagcagaagcaacauugggaggauuuggaucucuaggucuagauugugaaccuagaacaggacuggacuuuagugaccuuuauuacuuaacaaugaacaauaaacauuggcuaguacauaaagagugguuccaugauauaccacuaccauggcaugccggagcagauacaggaacuccccacuggaauaauaaagaagcucuaguagaauuuaaagacgcacaugccaaaagacaaacaguagucguauuaggaucccaagaaggagccguacauacagcacuagccggagcauuagaagcagaaauggauggagcaaaaggacgacugagcucaggucaucuaaaauguagauuaaaaauggacaaauuaagauuaaaaggggugucauacagucuauguacagccgcauuuacuuucacaaaaauaccagcugaaacauuacacggcacagugaccguugaaguacaauaugcaggaacagaugguccaugcaaaguacccgcacaaauggcagucgauaugcaaacauuaacaccaguaggaagauuaaucacagcaaauccaguaauaacagaaaguaccgaaaauucaaaaaugauguuggaauuagauccaccauuuggagauaguuauauaguaauaggaguuggagaaaaaaaaaucacccaccacuggcacagaaguggcaguacaauagguaaagcguucgaagcaacugucagaggagcaaaaagaauggccguacuuggagacacagcaugggauuuuggaucaguuggcggcgcucugaacucccuaggaaaaggaauccaucaaauauuuggagcagcauuuaaaaguuuauuuggagguaugaguugguucucacaaauacuaauuggaacacuucuaauguggcuaggacuaaauacaaagaacggcaguauaucauugauguguuuagcgcuaggaggcguacuaaucuuucuaagcacagcgguuucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6967 - RNA, 2485 nt, Artificial Sequence
  ZIKV prME variant mRNA Design 2 opt
ggggcgcugccuacggagguggcagccaucuccuucucggcaucaagcuuaccaugaaugcaagaaaagaaaagaaaagaagaggugccgauacauccguagguauaguuggcuuauuauuaacaacagccauggcagcugaagugacuagaagagguucagcauauuacauguaucuagauagaaaugacgcaggagaagcaauaaguuuucccacuacauuaggaaugaauaaauguuauauacaaauaauggaucuuggacacaugugcgaugcuacaaugaguuaugaauguccaauguuagaugaaggaguggaaccagaugauguagauuguugguguaacacgacaucaacuuggguaguuuauggaacaugucaucauaagaaaggagaagcaagacgaucaagacgagcaguaacacucccaagccacucuacaagaaaauuacagacaagaucacaaacaugguuagaaucccgagaauacacaaaacaccuaauuagaguagagaacuggauuuuuaggaauccaggauuugcauuagcggccgcugcaauagcauggcuacuaggaucaaguacaagucaaaaagucaucuauuuaguaaugauauuauuaauagccccugcauacucaauaagauguauuggcguaaguaauagagacuuuguagaagggaugaguggaggaacuuggguagauauaguauuagagcauggaggauguguaacaguaauggcacaagacaaaccaacuguagauauugaguuaguaacaacaacugugaguaacauggcagaaguaagauccuauugcuacgaagcauccauuucagauauggcuucagauaguagauguccaacucaaggagaagccuaucuagacaaacaaagugacacacaauauguuuguaaaagaacauuaguagauagaggaugggguaauggauguggcuuauucggaaaagguucauuaguuacaugcgcaaaauuugcuuguucaaagaaaaugaccggcaaaucaauucaacccgaaaauuuagaauauagaauaaugcucaguguacacggaagccaacauucagguaugauaguaaacgauacugggcaugaaacagacgaaaauagagcuaaaguagaaauuacaccaaauuccccaagagcagaagcuacauugggaggauuugggagucuaggacuugauugugaaccaagaacaggucuagacuucagugaucuguacuaucuuacaaugaauaacaaacauuggcuuguccauaaagaaugguuucacgacauaccacuaccauggcaugcaggagcagauacuggaacgccacacuggaauaacaaagaagcauuaguugaauuuaaagaugcacaugcgaaaagacaaacaguaguaguuuuagguagccaagaaggagcuguacauacagcauuagcaggagcauuagaagcagaaauggauggagcgaaagguagauuaucaucaggacaucuaaaaugucgacuaaaaauggauaaauuaagacucaaaggaguuucauacucauuauguacagcagccuuuacuuucaccaaaauaccagcagaaacacugcauggaacuguaacaguugaaguacaauacgcaggaacagauggaccauguaaaguaccagcgcagauggcaguagauaugcaaacacucacaccuguagguagacuaaucacagcaaauccgguaauaacagaaaguacagaaaauucuaaaaugaugcuagaacuagauccgccauucggagacagcuacauaguaauaggaguuggugagaagaaaauaacacaccauuggcacagaucaggaaguacaauaggaaaagcauuugaagcaaccguaagaggagccaaaaggauggcagucuuaggagauacagcaugggauuuuggaaguguagggggugccuuaaauuccuuggguaaagguauacaucaaauuuuuggagcagcauuuaaaucauuauuuggcggcauguccugguucucacaaauacugauaggaacucuauuaauguggcuuggcuuaaauacgaaaaauggaaguauaucauugaugugccuagcauuaggcggaguucuaauauuuuuaaguacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6968 - RNA, 2482 nt, Artificial Sequence
  ZIKV prME variant mRNA Design 2 opt
ggggcgcugccuacggagguggcagccaucuccuucucggcaucaagcuuaccauggcaagaaaagaaaagaaaagaagaggagcggacacaagugugggaauaguaggacuauuauuaacaacagcuauggcagcagagguaacgaggagaggaucagcauauuauauguaucuagaccgaaaugaugcaggagaagcuauuucauucccaacgacucuaggaaugaacaaaugcuacauacaaauaauggacuuaggacauaugugugacgccacaaugaguuaugaaugcccaaugcuagaugaaggcguagaaccagaugacguagauuguuggugcaauacaaccucgaccuggguagucuacggaacaugucaccauaagaaaggagaagcaagaaggucaagacgagccgucacuuuaccuagccauucaacacgaaaacuacaaacaagaucacaaacauggcuagaaaguagagaauauaccaaacauuuaauaagaguagaaaauuggauauucagaaacccaggauucgcauuagcugcagcagcuauagcuuggcuauuaggcagcucaacaagucaaaaagugauauaucugguaaugauacuacuuauagcuccugcauacucaauuagauguauaggcguaucaaauagagauuuuguugaaggaaugagcggaggaacauggguagacauaguauuagaacacgguggaugugugacaguuauggcacaagauaaaccaacaguagauauugagcuaguuacuacaacaguaucaaacauggccgaaguaagaaguuacugcuacgaagcaucaauaagugauauggcaucagauagcagauguccaacccaaggugaagcauauuuagauaaacaaucagauacucaauauguuuguaaaagaaccuuaguagauagaggauggggaaauggauguggguuauuuggaaaaggaaguuuaguaacaugcgcuaaauuugccuguucgaagaaaaugacaggaaaaucuauucaaccagaaaaucuagaauaccgaauaaugcuuagcgugcauggaagucaacacagcggaaugauagucaacgauacuggacaugaaacggaugaaaacagagcaaaaguugaaauaacaccgaauagucccagagcagaggcaacauuaggaggauuugguuccuuaggacuagacugcgagccaagaacaggccuagauuucagcgauuuauauuaucuaacuaugaacaauaaacacugguugguccauaaagaaugguuucaugauauacccuuaccuuggcaugcuggugcagauacaggaacaccacauuggaauaauaaagaagcacuuguagaauuuaaagaugcacaugcaaaaagacaaacaguaguagucuuaggaucucaagagggagcaguacacacggcacuugcuggggcauuagaagcagaaauggauggagcuaaaggucgauuaaguaguggacacuuaaaaugccgauuaaaaauggacaaauuaagauuaaaaggaguaucauauucacuaugcacagcugcuuucacauuuacaaaaauaccagcugaaacacuacauggaacaguaacaguagaaguacaauacgcaggaacagauggaccguguaaaguaccagcacaaauggcaguggauaugcaaacacuuacgccaguaggaagauuaauaacagcuaaucccguaauuacugaaaguacagaaaauucuaaaaugaugcuagaacuagacccaccuuucggugauaguuauauaguaauaggaguaggagaaaagaaaaucacacaucauuggcaucgaucaggaaguacaauaggaaaagcauuugaagcuacaguaagaggcgcuaaacgaauggcaguucugggagauacugcaugggauuuuggaaguguaggaggagcacuaaacucauuaggaaaaggcauccaccaaauauuuggagcugcauuuaaaagucuauucggagguaugucaugguucagucaaauauuaauaggaacguuauugaugugguuaggcuuaaauacuaaaaacgguucaauuucacuaaugugucuagcacuaggaggaguauuaauauucuuaaguacggcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6969 - RNA, 2479 nt, Artificial Sequence
  ZIKV prME variant mRNA Design 2 opt
ggggcgcugccuacggagguggcagccaucuccuucucggcaucaagcuuaccaugcggaaagaaaaaaaaagaagaggugcugauacaaguguaggaaucguaggacuauuauuaacaacagccauggcagccgaaguaacaaggagaggcuccgcauauuauauguaucuagaucgaaacgaugcuggugaagcaauaucuuuuccaacaacacuaggaaugaauaaauguuauauacaaauuauggaucuagggcauaugugcgaugcaacuaugaguuaugaaugcccaauguuagacgaggguguagaacccgaugauguugauuguugguguaauacaacaagcacauggguaguauauggaacaugccaccacaaaaaaggugaggcaagaagaagccgaagagcuguaacauuaccaucacauagcacuagaaaauuacaaacgagaagccaaacaugguuagaaucaagagaguacacuaagcaucuaauuagaguagaaaacuggauauuuagaaauccaggauucgcacuugcagcagcggcaauagcauggcuauuaggaucaucaacaagucaaaaaguaauauauuuaguuaugauacuuuuaauagcacccgcauauagcaucagaugcauuggaguaucaaauagagacuuugucgaagguaugucuggagguaccuggguagauauaguauuagaacaugguggauguguaacgguaauggcacaagacaaaccaacuguggauauagaacuaguaacuacaacaguaaguaauauggcagagguaagaucuuacugcuaugaagcaucaauaucagacauggcaagcgacucaagaugcccgacacaaggagaagccuauuuagauaaacaaucggacacgcaauauguuuguaaacgcacuuuaguagauagaggaugggguaauggaugugguuuauuuggaaaaggaagcuuaguuacaugugcuaaauucgcauguucaaaaaaaaugacaggaaaaucaauacaacccgaaaacuuggaauaucgaauaauguuaagcguacaugguucacaacacucagguaugauugucaaugacacaggucaugaaacagacgaaaacagagcaaaaguagaaauaacgccaaacucaccuagagcugaagcaacacuaggugguuuuggaucucugggacuagauugcgaaccaagaacaggacucgauuucagugauuuauauuacuuaacuaugaauaauaaacacuggcuaguccacaaagaaugguuucaugauauaccacugccauggcacgcaggugcagauaccgguacaccccauuggaauaacaaagaagcacuaguggaauuuaaagaugcacaugccaaacgucaaacagugguaguuuuaggaagucaagaaggagcaguccauacggcucuagcaggugcacuagaggcagaaauggauggggcuaaaggaagauuaucaaguggacauuuaaaguguagacuaaaaauggauaaauugagauuaaaagggguaaguuacucauuaugcacagcugcauuuacauucacaaaaauuccagcagaaacacuacauggcacaguaacaguagaaguccaauacgcaggaaccgaugguccguguaagguaccugcacaaauggcaguagacaugcaaacauuaacaccagucggccgacuaauaaccgcaaauccaguaauuacagaaaguacagaaaauaguaaaaugauguuagaauuagauccaccauuuggagauuccuacauuguuauaggaguaggugagaaaaaaauaacgcaucauuggcacagaaguggaaguacuauaggcaaagccuuugaagcuacaguaagaggggcgaaaagaauggcaguauuaggagauacagcuugggauuuuggaagugucggcggcgcacuuaauaguuuaggcaaagguauucaccaaauauuuggagcggcauucaaaucacuauucggaggaaugucuugguuuucucaaauauuaauaggaacauuacuaaugugguuaggacuaaauaccaaaaauggcuccauaucacucauguguuuagcauuaggagggguacuaauauucuuaagcacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6970 - RNA, 2476 nt, Artificial Sequence
  ZIKV prME variant mRNA Design 2 opt
ggggcgcugccuacggagguggcagccaucuccuucucggcaucaagcuuaccaugaaagaaaaaaaaagaagaggagcagauacaaguguagguauaguaggauuguuacuaacaacagcuauggcagcagaaguaacaagaagaggaagugcauauuauauguaccuagauagaaaugaugcaggugaagcaauaaguuuuccaacaacauugggaaugaauaaauguuauauacaaauaauggauuuaggacauaugugugacgcuaccaugucauacgaauguccaaugcuagaugaaggaguagaaccagaugauguagacuguugguguaacacuacuucaacauggguaguauauggaacaugccaucauaaaaaaggagaagcaagaagaucaagaagagcaguaacacuaccaucacauucuacaagaaaauuacaaacacgaagccaaacauggcuugaaucacgagaauauacaaaacaucuaauacguguagaaaacuggauauuuagaaacccgggauucgcuuuagcagccgcugcaauagcauggcugcuagguucaucaaccucacaaaaagucauauaucuaguuaugauacuacuaauagcucccgcauacucaaucagauguauaggaguaagcaauagagauuuuguugaaggaaugucaggagguacauggguagauauaguguuagaacauggaggauguguaacaguaauggcgcaagauaaaccaacaguagauauagaauuaguaacaacuacaguaaguaacauggcugagguuagaaguuacuguuacgaggcgucuauaagcgauauggcaucagacaguagauguccaacccaaggugaagcauauuuagauaagcagagugacacacaauauguaugcaaaagaacguuaguugaucgaggauggggaaauggauguggauuauuugguaaaggaagucuaguaacaugugccaaauuugcauguaguaaaaaaaugacaggaaaaagcauacaaccugaaaaucuagaauauaggauaauguuaaguguacauggaagccaacacucuggcaugauuguaaaugacacaggucaugaaacggacgagaacagagcgaaaguagaaauaaccccgaauagccccagagcugaagcaacauuagggggauuugguagucuagguuuagauugugaaccaagaacaggguuagauuuuagugauuuauauuacuugacaaugaacaacaaacauuggcuaguacacaaagaaugguuucacgauauaccacuacccuggcaugcuggagcggacacagguacaccccacuggaauaauaaagaagcucuagucgaauuuaaagaugcacaugcaaaaagacaaacaguaguaguuuuaggaucacaagaaggagcaguacauacggcacuagcaggagcguuagaagcagaaauggauggggcuaaagggcgauuaucaucaggacacuuaaaaugucgauuaaaaauggauaaacuaagauuaaaaggaguaucauauaguuuaugcacagcagcauuuacuuuuacaaaaauaccagccgaaacacuucaugguacuguaacaguggaaguccaguaugcuggaaccgauggaccauguaaagugccagcgcaaauggcaguagauaugcaaacauuaaccccgguaggcagacuuauaacugccaacccuguaauaacagaaucaacggaaaacucaaaaaugaugcuugaauuagauccgccauuuggagacagcuacauuguaauagguguaggagaaaaaaaaauaacacaccacuggcauaggucaggaucgaccauugguaaagcguuugaagcaacaguacgaggagcuaaaagaauggcaguacuuggagacacagcuugggauuuugguucuguaggaggugcauuaaacagccuaggaaaaggaauacaucaaauauuuggagcagcuuuuaaaagucuauuugguggaaugaguugguuuagccaaauauuaauuggaacguuauuaaugugguuaggguuaaauacaaagaacgguaguauuagucuuaugugcuuagcuuuaggaggaguacuaauauuuuuaagcacagccguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6971 - RNA, 2473 nt, Artificial Sequence
  ZIKV prME variant mRNA Design 2 opt
ggggcgcugccuacggagguggcagccaucuccuucucggcaucaagcuuaccauggaaaagaaaagaagaggggcggauacauccguaggaauaguuggacuauuauuaacaacugcaauggccgcagaaguaacacguagaggaucagcuuauuauauguaucuagauagaaacgaugcaggagaagcuauaaguuuuccaacaacacuaggaaugaauaaauguuauauacaaauaauggaccucggccacaugugugacgcuacaaugucuuaugaaugucccauguuagaugaaggagucgaaccagaugacguagauugcugguguaauacaacaucuacuuggguaguauaugguacaugucaucacaagaaaggugaagcaagaagaucacgaagggcaguaacuuuaccaucucacagcacuagaaaauuacaaacuagaagccaaacaugguuagaaucuagagaauauacaaaacauuuaauacgaguagaaaauuggauauuuagaaacccugguuuugccuuggcagccgccgcuauagcaugguuacuaggaucaucaacaagccaaaaaguaauauaccuaguuaugauacuacuaauugcaccagcauauucaauuagguguauaggaguuagcaauagagauuuuguagaagguaugucagguggaacauggguagacauuguauuagaacacggagguugugugacuguaauggcgcaagauaaaccaacaguagacauagaauuaguaacuacaacuguaaguaacauggcagagguaagaucguauugcuaugaagcaaguauaagugacauggcuucagauucaagauguccaacacaaggugaggcauaucuagacaaacaaucagacacacaauacguauguaaaagaacuuuaguagaccgcggcuggggaaacggaugcggacuauuugguaaaggaaguuuaguaacaugcgcaaaauucgcauguucuaagaaaaugacaggaaaaucaauacaaccugaaaaucuagaauauagaauaaugcuaaguguacauggaagucaacauucaggaaugauugugaacgacacuggacaugaaaccgaugaaaauagagcaaaaguagaaauaacaccaaauucgccaagagcagaagcaacucuuggggguuuuggaucauugggauuagauugcgagccuagaacaggauuagauuucagcgaucuuuauuacuugacaaugaauaauaaacauugguuaguacauaaagaaugguuccaugauauaccacuaccauggcaugcgggagcagauacugguacaccucauuggaacaauaaagaagcacugguagaguucaaagaugcccaugcaaaacgacaaacaguaguaguauuagggucacaagaaggagccguucacacagcacucgcuggcgcauuagaagccgaaauggauggcgcaaaaggaagauugucuucaggacaucuaaaaugccgauuaaaaauggacaaauuaagacuaaaagggguaagcuauucauuauguacagcggcauuuacauuuacaaaaauaccugcagaaacucuacauggaacaguaacaguggaaguacaauaugcagguacugacgguccuuguaaaguaccagcacaaauggcaguagacaugcaaacuuuaacaccaguagggagauuaauuacugcgaauccaguuauaacagaaaguacagaaaauucaaaaaugauguuagaauuagauccaccauucggagauagcuauauaguaauagguguaggagaaaagaaaauaacucaucacuggcacagaaguggauccacaauaggaaaagcauucgaagcaacaguaagaggcgcaaaaagaauggcaguauuaggcgacacugcaugggauuuugggucaguaggaggagcauugaauagucucgguaaagguauccaucaaauauuuggagccgccuuuaaaaguuuauucggaggaaugucuugguuuucucaaaucuuaauagguacacuacuaauguggcucggacuaaauacgaaaaauggcucgauaucacuaauguguuuagcucuaggagguguacuaauauuuuuaucaacagcagugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6972 - RNA, 2470 nt, Artificial Sequence
  ZIKV prME variant mRNA Design 2 opt
ggggcgcugccuacggagguggcagccaucuccuucucggcaucaagcuuaccaugaagaaaagaaggggagcagauacaaguguaggaauaguaggacuauuacugacaacagcaauggccgcggaaguaacaagaagaggaucagcuuacuacauguacuuagaccgaaaugaugcaggagaagcaauaucguuuccaaccacauuaggaaugaauaaauguuauauacaaauaauggauuuaggacauaugugugacgcaacaaugagcuaugaaugcccaaugcuagaugaaggagucgaaccugaugauguagauuguuggugcaacacaacuagcacuuggguaguauacggaacaugucaccauaagaaaggugaagcuagacgaaguaggagagcuguaacauuacccagucauagcacaagaaaauuacagacaagaagccaaacaugguuagaaucaagagaauacacaaaacaccuaauaagaguagaaaauuggauauuuagaaauccaggcuucgcucuggcagcagcagcgauagccuggcuacuaggaaguucgacaagucaaaaaguaauauauuuaguuaugauuuuacugauugcuccagcauauaguauaagauguauaggagucaguaaccgagauuuuguagaaggcaugucaggaggaacauggguagauauuguauuagaacauggagguugugucacaguaauggcacaagacaaaccaacaguagauauagaauuaguaacaacuacaguaaguaauauggcagagguaagaucauauuguuaugaagcauccauaagugauauggcaucagauucaagauguccuacucagggagaagcauauuuagauaaacaaagugauacacaauauguauguaaaaggacauuaguagaccguggauggggaaauggauguggacuauuuggaaaaggaucauuaguuacaugcgcaaaauuugcauguucuaagaaaaugacagguaaaagcauacaaccagaaaauuuagaauaucgcauuaugcuaucaguucauggaucccaacauucagguaugaucgugaacgauacagggcaugaaacagaugaaaauagagcaaaaguagaaauaacaccaaacagcccaagagcagaagcaacuuuaggcggcuuuggaaguuuaggauuagacugugaaccaagaacagguuuagauuuuucagaucuauacuauuuaacaaugaacaauaaacauugguuaguccauaaagaaugguuucacgacauacccuuaccauggcacgcgggugcagauacagguacuccacauuggaacaacaaagaagcauuaguagaauuuaaggacgcucaugcaaaaaggcaaacugugguaguauuaggaucacaagagggagcuguucacacagcauuagcaggagcucuagaagcagagauggauggagcaaaaggaagauuaaguucgggacaucuaaaaugucgacuaaaaauggacaagcuaagauuaaaaggaguaaguuauagucuaugcacagcagcuuuuacauuuaccaaaauaccagcugaaacgcuacaugggacaguaacaguagaaguacaauaugcagguacagaugggccuuguaaaguaccagcacaaauggcaguagauaugcaaacacuaacaccaguaggacgauuaauaacagcaaauccagugauuacugaaagcacagaaaacaguaaaaugaugcuagaauuagacccacccuuuggagacaguuauauaguaauaggcguaggagaaaagaaaauaacucaucacuggcauagaaguggaagcacaauaggaaaagcauuugaagcaacaguuagaggagcaaaacgaauggcugugcuaggagauacagcuugggauuuuggcucaguaggaggggcauuaaauucauuagguaaaggaauacaucaaauauucggugcagcauuuaaaagucuauuugguggaaugaguugguuuucacaaauauuaauagguacucuacuaaugugguugggauuaaacacgaaaaacggaucaaucagucuaaugugccuagcgcuugggggcguguuaauauuuuuaaguacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6973 - RNA, 2467 nt, Artificial Sequence
  ZIKV prME variant mRNA Design 2 opt
ggggcgcugccuacggagguggcagccaucuccuucucggcaucaagcuuaccaugaaaagacguggagcugauacaagugucggcauuguaggucuguuauuaacaacagcaauggccgcagaaguaacaagaagaggaucagcauauuauauguauuuagauagaaaugaugccggagaagcaauaucuuuuccuacaacauuagggaugaauaaaugcuauauucaaauaauggauuuagggcacaugugugaugcaacgaugaguuacgaaugcccaauguuagaugaaggaguagaaccggacgauguagauuguugguguaacacuacaucaacauggguuguuuacggaacaugucaucauaagaaaggagaagcaaggagaagucgcagagcagucacauuaccuagucacucaacaagaaaauuacaaacaagaagucaaacaugguuagaaaguagagaauauaccaaacaucuaauaagagucgaaaauuggauuuuuagaaacccgggauucgcacuggcagcagcugccauugcauggcuccugggaucaaguacgucacaaaaaguaauauauuuaguaaugaucuuauuaaucgcaccggcauacucaauuagauguauaggaguaagcaacagagauuuuguagaagggaugucagguggaacauggguagauaucguauuagaacauggcgggugugucacaguaauggcacaagauaaaccuacaguugauauagaauuagugacaaccacaguuaguaauauggcagaaguacgaucauauuguuaugaggcuuccauaucagacauggcaagugacucacgaugcccaacucaaggagaagccuauuuagacaaacaaucugauacacaauacguaugcaaaaggaccuuagucgacagagguuggggaaauggaugcggacuauuugggaaagguagcuuaguaacaugugcaaaauuugcaugcucgaagaaaaugacaggaaaaagcauacaaccagaaaauuuagaauauagaauaauguuaagcguucauggaucacaacacaguggaaugauaguaaaugauacagggcaugaaacagacgaaaauagagcuaaaguagaaauaacuccaaacagcccaagagcggaagcaacauuaggaggauuuggaaguuuaggacuagauugcgaacccagaacaggacuggacuuuagcgaccuauauuauuuaacaaugaauaauaaacauuggcugguucauaaagaaugguuucaugauauuccuuuaccguggcaugccggugcagauacagguacaccacauuggaauaacaaagaagcacucguagaauuuaaagaugcacaugcaaaaagacaaacaguaguagucuuaggaucccaagaaggagcaguacacacugcucuagcgggagcccuagaagcagaaauggacggcgcuaaaggaagauuaucuucaggacaucuaaaauguagacuaaaaauggauaagcuaagauuaaaaggcguaucuuauagccuauguacugcagcuuuuacauuuacaaaaauaccagcagaaacuuuacauggaacaguaacaguagaaguacaauacgcaggaacugacggaccaugcaaaguucccgcacaaauggcagucgacaugcagacacuaacaccaguuggaagauuaauaacagcaaauccaguaauaacagaaucaacagaaaauucuaaaaugaugcuugaauuagacccgcccuucggagauucauauauaguaauugguguaggagaaaagaaaauaacccaucacuggcacagaaguggauccacaauagguaaagcauuugaagcaacaguaagaggugccaaaaggauggcaguccuaggagauacagccugggauuuuggaaguguugguggggcacuuaacaguuuaggaaaaggaauacaucaaauuuuuggagcagcauucaaaagucuauucggaggaaugaguugguuuucacaaauacuaaucggaacacuauuaaugugguuaggauuaaauacuaaaaacggaagcauaucauuaaugugucuugcauuaggcggagugcuaaucuuuuuaagcacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6974 - RNA, 2464 nt, Artificial Sequence
  ZIKV prME variant mRNA Design 2 opt
ggggcgcugccuacggagguggcagccaucuccuucucggcaucaagcuuaccaugagaaggggugcggauacaucuguaggaauaguaggauuauuauuaacaacggcaauggcagcagaaguuacaagaagaggaagugcuuacuacauguauuuagauagaaacgaugcuggugaagccauaaguuucccaacuacauuaggaaugaacaaaugcuacauccaaaucauggaccuuggacauaugugugaugcuacaaugucauacgaauguccaaugcuggaugaagguguagaacccgaugauguagacuguugguguaacacaacaucuacuuggguuguuuaugguacgugucaccauaagaaaggugaagcaagacgaucaagacgagcaguaacauuacccagucacucaaccagaaaacuacaaacaagaucacaaacaugguuagaaucaagagaauauacaaaacaucuuauaagaguagaaaacuggaucuuuagaaacccuggauuugcauuagcagcagcagcuauagcaugguuacuagguucgaguacaagucaaaaaguuauuuaucucguaaugauacuauuaauagcaccagcuuauagcauaagauguauagguguaucaaauagagauuuuguagaagggaugucaggagggacauggguagauaucguauuagaacauggaggauguguaacagucauggcgcaagacaaaccaacaguugauauagaauuaguaacaacaacaguuuccaauauggcagaaguuagaucauauuguuaugaagcuagcaucucagauauggcuuccgacucaagauguccaacacaaggagaagcauauuuagacaaacaaucugauacacaauauguauguaaaagaacucuaguagauagagguuggggaaaugguuguggauuauuuggcaaaggaucuuuaguuacaugcgcaaaauuugcauguaguaagaaaaugacaggaaaaagcauucaaccugaaaauuuagaauauagaauaaugcuaucaguacacggaagucaacauagcgguaugauaguaaacgauacaggacaugaaacagaugaaaacagagcaaaaguggaaauaacaccaaacucaccuagagcagaagcaacauuaggcggauuugguaguuuaggauuagacugugaaccaagaacaggguuagauuuuagugauuuguauuauuuaacaaugaauaacaaacauuggcuaguacauaaagaaugguuccacgauauaccauuaccguggcaugcaggggcagauacuggaacuccccauuggaacaauaaagaagccuugguagaauuuaaagacgcacaugcaaaacgacaaacagucguaguauuaggcucacaagaaggcgcaguacauaccgcuuuagcaggcgcuuuagaagcagaaauggauggagccaaaggaaggcuaucaucuggucaucuuaaauguagacuaaaaauggauaaacuaagacuaaaaggaguuucuuacagucucuguacagcagcauuuacauucacgaaaauaccagcugaaacacuacauggaacuguaacaguagaaguacaauaugcaggaaccgauggaccauguaaaguaccagcacaaauggcaguugauaugcaaacauuaaccccaguagggagacuaauaaccgcaaauccaguuauuacagaaucaacagaaaacaguaaaaugaugcuagaauuagaucccccuuuuggcgauucauacaucguaauaggugugggagaaaagaaaauaacgcaucacuggcaucgaucaggaagcacaauaggaaaagcauuugaagcuacagucagaggagcuaaaagaauggccguucuaggagacacugcuugggacuucggaucaguugguggagcauuaaauucucugggaaaaggaauacaucaaauauuuggugcagccuucaaaucacuauuugguggcaugaguugguucucacagauacuaauagguaccuuauuaauguggcuaggauuaaauacuaaaaacggaucaauaucauugaugugcuuagcccuaggaggaguuuuaauauuucuaagcacagcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6975 - RNA, 2461 nt, Artificial Sequence
  ZIKV prME variant mRNA Design 2 opt
ggggcgcugccuacggagguggcagccaucuccuucucggcaucaagcuuaccaugcgaggagccgauacaagcguuggaauaguugguuuauuauuaacaacagcuauggcagcagaaguaaccagacguggaucggcauauuauauguaccuagacaggaaugaugcaggagaagcaauaucuuuucccacaacuuuaggaaugaauaaaugcuauauacaaauaauggauuuaggacauaugugugaugcaacuaugagcuaugaaugcccuauguuggaugaagggguugaaccagaugauguagauuguuggugcaacacuacaucaaccuggguuguauauggaacaugucaucacaagaaaggagaagcucgcagaagcagacgagcaguaacacuaccuucacauagcacaagaaaacuacaaacacgaucucaaacaugguuagaaagcagagaauacacaaaacaccuaauaaggguagaaaauuggauauuuagaaacccaggguuugcauuagcagcagcggcuauagccuggcuauuaggaucuaguacaucacaaaaaguaaucuacuuagugaugauauuauuaauugcaccagcauacucaauaagauguauaggaguuagcaauagagauuucgucgaaggaaugucaggcggaacauggguagauauuguauuggaacauggaggaugcguaacaguaauggcacaagauaaaccuacuguagacauagaauuaguaacaacaacuguaagcaacauggcagaaguaaggucauauuguuacgaagcaaguauaucagauauggcaagugauucgagauguccaacacaaggcgaagcauauuuagacaaacaaucagauacacaauauguauguaaaagaacccuaguagauagaggauggggaaauggauguggucuauuuggaaaaggaaguuuaguaacaugcgcuaaauucgcaugcagcaagaaaaugacaggaaaaucuauacaaccagaaaauuuagaauacaggauaauguuaucaguccacggaagucaacauucaggaaugauagucaaugacacaggacaugaaacugacgaaaauagagcaaaaguagaaauaacaccaaacucaccaagagcagaagcaacacuagguggcuucgguucauuaggacuggacugugaaccaagaacaggauuagacuucagcgauuuauacuacuuaacuaugaauaacaaacauuggcuaguacauaaagaaugguuccaugacauaccauuaccuuggcaugcuggugcagauacuggaacaccacauuggaauaauaaagaagcgcuaguggaguucaaagaugcacaugcuaaacgacaaacaguaguaguauuaggcucacaagaaggagccguccauacagcacuugcaggagcacuugaagcagaaauggauggagcaaaaggaagauuaucgaguggccacuuaaaaugucgacuaaaaauggauaaacuaagauuaaaaggaguuucauauaguuuauguacagcagcauuuacauucaccaaaauuccagcagaaacauuacauggaaccguaacuguggaaguacaauaugcaggaacagauggacccuguaaaguaccagcacaaauggcagucgauaugcaaaccuuaacaccaguaggaagauuaaucaccgcaaacccugugauaacagaaucuacagaaaacaguaaaaugaugcuagaauuggauccuccauucggagauuccuauauaguaauaggaguaggagaaaagaaaauuacucaccacuggcacagaucagguagcaccauagguaaagcauuugaagcuacaguaagaggugcaaaaaggauggcuguauuaggcgacacagcaugggauuucggaucaguuggaggcgcuuuaaacucacucggaaaaggcauucaucaaauauuuggagcagcauuuaaaaguuuauuuggaggaaugucaugguuuucacaaauucuaauaggaacauuacuaauguggcugggucucaauaccaaaaacggcaguaucagcuugaugugucuagcauuaggaggcguacuaauauuccuaagcacagcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6976 - RNA, 2458 nt, Artificial Sequence
  ZIKV prME variant mRNA Design 2 opt
ggggcgcugccuacggagguggcagccaucuccuucucggcaucaagcuuaccaugggcgcagauacaaguguaggaauuguaggguuauuacuaacaacagcaauggcagcagaaguaacaagaagagguagugcauauuauauguaucuugauagaaacgaugcaggagaagcuauuucauuuccaacaacacuaggcaugaauaaauguuauauacaaaucauggauuuaggacacaugugcgaugcuacaaugaguuaugaauguccaaugcuagacgaaggcguugaaccagaugauguagauugcugguguaacacaacaaguacuuggguaguuuauggcaccugucaucacaagaaaggagaagcgcgaagaaguagacgagcaguaacauuaccaucacauagcacaagaaaauugcagacuagaagucaaacauggcuugaaucaagagaauauacaaaacauuuaauacgaguugaaaacuggauauuccgaaauccagguuuugcacuagcagcagcagcaauagcauggcuacugggaucaaguacuagccaaaaaguaauauauuuaguaaugauauuacuaauagcccccgcguacaguauaaggugcauagguguaucgaauagggauuuuguugaaggaaugagcggagggacuuggguggauauaguacuagaacauggagguuguguuacaguaauggcacaagauaaaccaacaguugacauagaauuagugacaacaacuguaagcaauauggcugaaguaaggagcuauugcuaugaagcaaguauaucagauauggcaagugauucaagauguccaacacaaggugaagcauacuuagauaaacaauccgauacucaauauguauguaaaagaacucuaguagaucgaggauggggaaacggauguggauuauuuggaaaagggaguuuaguaacaugcgcaaaauuugcauguaguaagaaaaugacaggaaaaucaauacagccagaaaaucuagaauaucggauaaugcuaucaguacaugguagucaacauucaggaaugauaguaaacgauacaggucacgaaacagacgaaaaucgagcaaaaguugaaauaacaccuaacaguccacgagcugaagcaacauuaggcggauuuggaucccuaggauuagacugugaaccgaggacaggacuagauuuuucagaucuauauuauuuaacaaugaacaauaaacauuggcuaguucauaaagaaugguuucaugauauaccauuaccauggcaugcuggugcagacacaggaacaccucauuggaauaauaaagaagcauuaguagaauuuaaagacgcacacgcaaaaagacaaacaguuguaguauuaggaagccaagaaggagcuguacauacagcacuugcuggagcacuagaagcugaaauggauggugcuaaaggcagauuaagcaguggucauuuaaaaugcagauugaaaauggauaaauuacgauuaaaaggaguaucauauuccuuaugcacagcagcauuuacauuuacaaaaauaccagcagaaacauuacauggaacaguaacaguagaaguccaauaugcaggaacagacggaccaugcaaaguaccagcacaaauggcaguugauaugcagacacuaacaccaguaggaagauuaauaacugcaaacccgguaauaaccgaaaguacagaaaauucaaaaaugauguuggagcuggauccaccauuuggggacucauacauaguaauuggcguaggagaaaagaaaauuacacaccacuggcaucgaaguggaagcacaauaggaaaagcauucgaagccacaguaaggggagcaaaaagaauggcaguauuaggugacacagcaugggacuucgguucaguaggaggugcuuuaaauaguuuagguaaaggaauacaccaaauauuuggagcagcauuuaaaucauuauuuggaggaaugaguugguuuucacaaauucugauaggaacguuacuaauguggcuuggcuuaaauacgaaaaauggaagcauuucauuaauguguuuagcgcuugguggaguuuuaauauuuuuaucuacugcaguuagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6977 - RNA, 2455 nt, Artificial Sequence
  ZIKV prME variant mRNA Design 2 opt
ggggcgcugccuacggagguggcagccaucuccuucucggcaucaagcuuaccauggcagauacgucugucggaauaguuggauuacuacuaacaacugcaauggccgcagaagugacuagacgagguucggcguacuacauguaucuagacagaaaugaugcuggagaagccauaucauuuccaacuacauuaggaaugaauaaaugcuacauacaaauuauggaccuaggacauaugugugacgcaacaaugucauaugaauguccaauguuagaugaagggguagaaccagacgacguagauugcugguguaacacaacaucuacaugggugguuuacgguacaugucaucauaagaaaggugaagcaagacgcucaagacgagcaguaacacugccaucacauaguacaagaaaacuacaaacaagaucacaaacauggcucgaaucgagagaauacacaaaacaucuuauaagaguagaaaauuggauauucagaaaucccggcuucgcacuagcugcagcagcaauagcaugguuacuuggaaguucuacgagucaaaaaguaauauaucuaguaaugauacuucuaaucgcgccugcauauagcauaagguguaucggggucucaaauagagacuuuguagaaggaaugucaggaggaacauggguagauauuguguuagaacaugguggaugugucacaguaauggcacaagacaaacccacaguagacauagaauuaguuacuaccacaguaucaaacauggcagaaguucgaucguauuguuaugaagcauccauaagugauauggcaucagacaguagaugcccuacccaaggagaagcauauuuagauaaacaaagcgauacucaauacguauguaaaagaacccuaguagaucguggaugggguaacggaugugguuuauuugguaaaggcaguuuaguaacuugugcaaaguuugcauguucaaagaaaaugacagguaaaucuauacaaccggaaaaccuagaauaucgaauaaugcuaaguguacauggaucucagcauaguggaaugauaguaaaugacacagggcaugaaacagaugaaaacagagcgaaaguagaaauaacuccaaacagcccaagagcagaagcaacauuaggaggauuuggcagucuaggacuagauugugaaccaagaacuggauuagauuuuucagaucuuuacuacuuaacuaugaacaacaaacauugguuaguacacaaagaaugguuucaugacauaccgcuaccauggcacgcuggugcagauaccggcacaccucauuggaauaauaaagaagccuuaguagaauuuaaagacgcacaugcaaaaagacaaacaguaguaguacuaggaucacaggaaggagcaguacauacagcccuagcuggagcauuagaagcggaaauggacggagcuaaaggaagauugucaagcggacacuuaaaaugucgacuaaaaauggauaaacuaagacuuaaaggaguaucauauagcuuaugcacagcagcauuuacauuuacaaaaauaccggcagaaaccuugcaugggacuguaacaguagaaguacaauaugcagggacagauggcccauguaaaguaccagcacaaauggcaguagauaugcaaacccuaacuccaguaggaagauuaauaaccgcaaauccaguaauaacugaaagcacggaaaacucaaaaaugaugcuagaacuagauccaccauucggagacaguuauauaguaauaggcguaggagaaaagaaaauaacgcaccauuggcauagaagcggaaguacaaucggaaaagcauuugaagcaacaguaagaggcgcaaaaagaauggcaguacuaggagauacagcaugggacuuuggaucgguaggaggggcauuaaacaguuuagggaaaggaauacaucaaauauuuggagcagcauuuaaaucacuauucggaggaaugagcugguucucacaaauauuaauagggacauuauugauguggcuaggccuuaacacuaaaaauggaucaauaagucuaauguguuuggcauuaggcggaguacuaauauuuuuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6978 - RNA, 2452 nt, Artificial Sequence
  ZIKV prME variant mRNA Design 2 opt
ggggcgcugccuacggagguggcagccaucuccuucucggcaucaagcuuaccauggauaccucaguuggaauaguaggacugcuauuaacaacagcuauggcugccgaaguaacaagaagaggaagcgcauacuauauguacuuagauagaaaugaugcgggagaagcaauaaguuuuccaaccacacuaggaaugaauaaauguuacauacaaauaauggaucuagggcauaugugugaugcgacaaugucauaugaauguccaauguuggaugaaggcguagaacccgaugauguagacuguugguguaacacaacaagcacauggguaguauauggaacaugucaucacaagaaaggagaagcacgaagaaguaggagagcaguuacauuaccaucacauaguacuagaaaauugcaaacuagaucacaaacaugguuagaaagccgcgaauauacaaaacauuugauaagaguagaaaauuggauuuuuagaaacccaggcuucgcacuagccgcagcagcaaucgcauggcuucuaggaagcucuaccucacaaaaaguaauauauuugguaaugauauuauuaauagcaccagcuuauaguauaagauguaucggaguaaguaauagagauuuuguagaaggaaugaguggaggaacauggguagacauagucuuagaacauggaggauguguuacaguaauggcgcaagauaaaccaacaguagauauagaauuaguaaccacaacaguaaguaauauggcagaaguaagaaguuauuguuaugaagcaagcauuagugauauggcaucagauagucgauguccaacacagggagaagcauacuuggacaaacaaagugacacucaguauguauguaagagaacauugguagauagaggaugggguaaugguuguggauuauucggaaaaggaucguuggucaccugugcaaaauuugcuuguagcaagaaaaugaccggaaaaucaauucagccagaaaacuuagaauauagaauaauguuaagcguucauggaagucaacauagcggcaugauaguaaaugauacaggacacgaaacagacgaaaacagagcaaaaguagaaauuacaccaaauaguccaagagcagaagcaacauuaggagguuuuggaucucuuggauuggauugugaaccaaggaccggacuggauuuuucagaccuauauuacuuaacaaugaauaauaaacauugguuaguacacaaagaaugguuucacgacauuccauuaccuuggcacgccggagcagauacugggacaccgcauuggaauaauaaagaagcauuaguagaauuuaaagacgcacacgcaaaacgacaaacaguaguuguucuaggaagucaagagggggcaguucauacagccuuagcaggggcacuagaggcagaaauggauggagcuaaaggaagacuaaguaguggacacuuaaaauguagauuaaaaauggacaaauuacgucucaagggagucuccuauagcuuguguacagcagcauuuacuuucacaaaaauaccagcagaaacuuuacauggaacaguaaccguagaaguacaauaugcaggaacagauggaccaugcaaaguaccagcacaaauggcagucgacaugcaaacacuaacaccaguagggagacuaaucacagcaaauccuguaauaacagaaucaacugaaaauagcaagaugauguuagaauuagauccaccauuuggagauucauacauaguaauuggaguaggugaaaagaagauaacacaucacuggcacagaaguggaucaaccauaggaaaggcuuuugaagcaaccguaagaggugcaaaacgaauggcuguuuuaggagacacagcaugggacuuugggucaguagguggagcauuaaauagucuaggaaaagguauucaucaaauauuuggagcagcuuuuaaaaguuuauucggaggaaugucaugguucagccaaauauugauaggaacuuuauuaauguggcuaggauugaauaccaaaaaugguaguauuagucuaaugugucuugcguuaggaggaguauuaauauuuuuaagcacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6979 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugacaagcguaggaauaguuggauuauuacuaacaacagcaauggcagcugaaguaacuagaagaggaagcgcauauuauauguaccuagaucgaaacgacgcuggagaagcaauaucuuucccaacuacauuaggcaugaauaaaugcuauauacaaauaauggauuuaggacauaugugcgaugcaacaaugucauacgaaugucccauguuagacgaaggaguagaaccagaugauguagauuguuggugcaauacaacaucaacaugggucgucuauggcacaugucaucauaagaaaggugaagcacggagaagucgcagagcaguuacacuaccgucacauucaacaagaaaacuacaaacuagaucacaaaccugguuggaaaguagagaauauacaaaacaucuaauaaggguagaaaauuggauauucagaaaccccggauuugcuuuagcugcagcagcaauagcauggcuacuaggaaguagcacaucacaaaaaguaauauaucuaguaaugauacuacuaauagcgccagcguauaguauaagauguauaggaguaucuaaccgugauuuuguggaagggaugucagguggaacauggguagauauuguauuagaacauggaggauguguaacagucauggcgcaagacaaaccaacuguagauauagagcuaguaaccacaacuguaucaaauauggcagaaguuagauccuauugcuacgaagcaucgauuagcgauauggcaagugauuccagauguccaacccaaggagaggcuuacuuagauaaacaaagugauacacaauauguaugcaaaagaacauuagucgauagaggauggggaaauggaugcggguuauucggaaaaggaucuuuagugacaugugcaaaauuugcuuguucuaagaaaaugacaggcaaaucaauacaaccagaaaacuuagaauauagaauuauguuaucaguacacggaucacaacauagcggaaugauugucaaugauacaggacaugaaacagaugaaaauagagcaaaaguagaaauaacaccuaauucaccuagagcagaagcaacacuaggaggauucggaaguuuagguuuggauugcgaaccacgaacuggucuagauuuuucagauuuauacuauuugacaaugaauaauaaacauugguugguacauaaagaaugguuucaugacauaccacuaccuuggcaugcaggagcagacacuggaacaccacacuggaacaauaaagaagcacuugucgaguucaaagaugcacaugcuaaaagacaaacaguuguuguauuaggaagccaagaaggagcaguacauacagcauuagcaggggcguuagaagcagaaauggauggagcaaaaggcagacuuucuuccggacauuuaaaauguagauuaaaaauggauaaauuacgccuaaaaggugucucauacucauuauguacagcagcauuuaccuuuaccaaaauuccagcggaaacccuucauggaaccguaacaguugaaguucaauaugcuggcacagacggaccaugcaaaguaccugcacaaauggcaguagauaugcaaacucuaacuccaguugggagacuaauaacagccaauccaguuaucacagaaagcacagaaaauucaaagaugaugcucgaauuagauccgccauucggugacucuuauauaguuauaggaguaggugaaaagaaaauaacacaucauuggcaccguagcggaagcacuauuggaaaagcauuugaagcaacaguuagaggugcaaaaagaauggcaguacuaggagauaccgcaugggauuucggaagugucggcggagcacuaaauucauuagguaaagguauacaucaaauauuuggagcagcuuuuaaaagccuauuugguggaaugaguugguucucgcaaauauuaauaggaacccuuuuaauguggcuaggacuaaauacuaaaaauggaaguauaagccucaugugucuagcacuugggggaguauuaauauucuuauccacagcuguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6980 - RNA, 2449 nt, Artificial Sequence
  ZIKV prME variant mRNA Design 2 opt
ggggcgcugccuacggagguggcagccaucuccuucucggcaucaagcuuaccaugacgucaguaggaauugucggauuauuauuaacuacagcaauggcagcagcuguaaccagaaggggaucagccuacuauauguauuuggaccgaaaugaugcuggugaagcaauaucauuuccaacuacauuagguaugaauaaaugcuauauacaaauaauggaucuuggacauaugugugaugcaaccaugaguuaugaauguccuauguuagaugaaggaguagaaccugaugacguagauugcugguguaacacaacuucaacauggguaguauauggaacaugccaucacaagaaaggagaagcaagacgaagccggagagcaguaacauuaccaagucacucaacgagaaaauuacaaacaagaucacaaacauggcuugaaaguagagaauacacuaaacauuuaauaagagucgaaaacuggauauuuagaaauccaggauuugcacuagcagcugcagccauugcaugguuauuaggaucaaguacaucucaaaaagucauuuacuuaguaaugauauuacucauagcuccugcauauucaaucagaugcauaggcguuucaaacagagauuucguagaaggaaugucagguggaacauggguagauaucguacuagaacacggaggaugcguuacaguaauggcacaggauaaaccaaccguagacauagaauuaguaacaacuacuguaaguaauauggccgaaguaagaucauauuguuaugaagccaguauuagcgauauggccagcgauagcagauguccaacgcaaggagaagcauacuuagauaaacaaagugauacucaauauguauguaaacgaacauuaguagaucgaggaugggguaacggaugcgguuuauuuggaaaaggaucauuaguaacaugcgcaaaauuugcaugcucuaagaaaaugacuggaaaaucaauacaaccagaaaaucuagaauacagaauaauguuaucgguacauggaagccaacauucaggaaugauaguaaacgacacuggacaugaaaccgacgaaaauagagccaaaguagaaauaacaccuaauuccccaagagcagaagcaacauuaggaggauucggaagccuaggacuagauugugaaccaagaacuggucuugacuucucagacuuauacuaccuaaccaugaacaacaaacacugguuaguacauaaagaaugguuccacgacauaccauuaccuuggcacgcuggagcagacacaggcacaccccacuggaauaauaaagaggcuuuaguugaguucaaagaugcucacgcuaaaagacaaacaguaguaguacuagguucacaagaaggugcaguacauacagcuuuagcaggagcacucgaagcagaaauggauggagcaaaaggaagauuaucaaguggacaucuaaagugcaggcuaaaaauggauaaguuaaggcuaaaaggaguaucauauucucuaugcacagcagcauuuacauucacaaaaauaccagcagaaaccuuacauggcaccguaacaguagaaguacaauaugcagguacagauggcccuuguaaagucccagcacaaauggccguagauaugcaaacauuaacaccagugggcagauuaauaacagcaaaccccguaauaacugaaaguacagaaaauaguaaaaugaugcuagaauuagauccuccauuuggcgauaguuauauaguaauaggaguaggagaaaagaaaauaacacaucacuggcaccgcagcggaaguacuauuggaaaagcauuugaagcaacuguaagaggagcaaaaagaauggcuguucuaggagacacagcuugggacuuugguucuguaggaggagcacuaaauaguuugggaaaaggcauacaucaaauuuuuggcgcugcauucaaaucacuauuuggaggaaugaguugguuuucacaaauucucauaggaacauuauuaauguggcuaggguuaaacacgaaaaauggaaguauaucauuaauguguuuagccuuagguggaguauuaaucuucuuaucuacagcaguaucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6981 - RNA, 2461 nt, Artificial Sequence
  ZIKV prME variant mRNA Design 2 opt
ggggcgcugccuacggagguggcagccaucuccuucucggcaucaagcuuaccaugcguggagcugauaccucaguugguauaguaggcuuacuauuaacaacagcaauggcugccgcuguuacuagaagaggaucagcauauuauauguacuuagauagaaaugaugcaggagaagcaaucucauuucccacuacuuuaggcaugaauaaauguuacauucaaauaauggauuuaggacauaugugugaugcaacaaugucauacgaaugcccaauguuagaugaaggcguagagcccgaugauguagauuguugguguaauacuacaucuacuuggguaguguauggaacaugucaucacaaaaaaggagaagcaagacgaagcagacgagcaguaacauugccaucucacucaacaagaaaauuacaaacaagaucacaaacauggcuagaaucuagagaauacacaaaacauuuaauaagaguagaaaauuggauauuuagaaauccaggauucgcguuggcggccgcagcgauagcaugguuauuaggaucaaguacaucacaaaaaguuaucuauuuaguaaugauccuacuaauagcaccagcguauaguauuagauguauaggcguaucaaauagagauuucguagaggggaugagugguggaacauggguagauauaguuuuagaacaugguggguguguaacgguaauggcucaagauaaaccaaccguagauauagaguuagucacaacuacagucagcaauauggccgaaguaagaucauacuguuaugaagcaucaaucucagauauggccagugacaguagauguccaacucaaggagaagcuuaucucgacaaacaaagugauacacaauauguauguaaaaggacacuaguggauagagguugggguaaugguuguggacucuuuggcaaagguagucuagucacgugcgcuaaauuugcuugcucaaaaaaaaugacgggaaaaagcauacaaccugaaaauuuagaauaccgaauaauguuaucaguucauggcagucaacauagcgggaugauaguuaacgauacaggacaugaaacagaugaaaauagagcaaaaguggaaauaacaccuaacucaccuagagcggaagccacguuaggaggauuuggaaguuuaggauuagauugcgaaccaaggacaggauuagauuucucagauuuauauuaucuaacuaugaauaacaaacacugguuaguacauaaagagugguuccacgauauuccacuaccauggcaugcuggggcagacacuggaacaccucauuggaauaauaaagaagcauuaguagaauucaaagacgcacaugcuaaaagacaaacuguagugguacuaggaagucaagaaggagcaguacauaccgcacuugcuggagcacuagaagcagaaauggauggugcaaaaggaagacuuucaaguggacaucuaaaauguagauuaaaaauggacaaauuaagauuaaaaggaguaucauacucauuauguacagcagccuuuacauucacaaaaauaccugcagaaacacuucauggaacaguaacaguagaaguacaauaugcuggaacugauggcccguguaaaguucccgcucaaauggcaguugauaugcaaacauuaaccccugucgggagauugauaacagcuaauccaguuauaacagaaucuacugaaaacucaaaaaugauguuagaauuagacccaccauucggagauagcuauauaguaaucgggguaggugaaaaaaaaauuacacaccauuggcacagaaguggaucuacaauaggaaaagcauuugaagccacuguuagaggagcaaaacgaauggcaguacuaggugacaccgcaugggauuuuggaucagucggcggugcauuaaacucacuaggaaaaggaauccaucaaauauuuggagcugcauuuaaaagccuauuugguggaaugucaugguuuagccaaauacuaauuggaacuuuauuaauguggcuaggauuaaauacaaaaaauggaucaauuagcuuaauguguuuagccuuaggaggaguuuuaauauucuuaagcacagcuguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6982 - RNA, 2485 nt, Artificial Sequence
  ZIKV prME variant mRNA Design 2 opt
ggggcgcugccuacggagguggcagccaucuccuucucggcaucaagcuuaccaugagaggacuaucuagcagaaaaagaagaucacaugacguauuaaccguucaguucuuaauauuaggaauguuauuaaugacaggaggaguaacaagacguggcuccgcguauuauauguaccuagauagaaaugaugcaggagaagcaauuucauuuccuacaacuuuaggaaugaauaaaugcuauauacaaaucauggaccuaggacauaugugcgaugccacaaugagcuaugaauguccaauguuagaugaaggcguagaaccagaugacgucgauugcugguguaacacaacuucaaccuggguaguauauggaaccugucaucauaagaaaggagaagcaagacgaucaaggcgagcaguaacauuaccaucucacucaacaagaaaauuacagacaagaucacaaacauggcuagaaaguagagaauauacaaaacauuuaauaagagucgaaaauuggaucuuucguaauccugguuuugcacuagcugcagcugcuauagcuugguuauuaggcucaagcacaucacaaaaaguuauuuacuuaguaaugauauuacuaauagcaccagcuuacucaauaagauguauagguguuuccaacagagauuuuguagaagguaugucuggaggaacuuggguugauaucgucuuggagcaugguggauguguaacgguaauggcucaagauaaaccuacaguagauauagagcuaguuacgacaacaguuagcaauauggcugaaguccgaaguuauugcuacgaagcaagcauaagugauauggcaagugauucaagaugcccaacacaaggagaagcauaucuagauaaacaaagugacacacaauacguuuguaaaagaacucuuguagauagggguuggggcaauggaugugguuuauucggaaaaggaaguuuaguaacaugugcuaaauuugcuuguucuaagaaaaugacuggcaaaucaauucaaccagaaaauuuagaauacagaauaaugcuaucaguucaugguucacaacauucuggaaugauaguaaaugauacaggacaugaaacagaugaaaaucgugcuaaaguagaaauuacaccaaacucaccaagagcagaagcaacucuugguggauuuggcucauugggguuggauugcgaaccaagaacuggauuagauuucagugauuuguauuauuuaacuaugaauaauaaacacuggcuaguucauaaagagugguuccacgacauaccauuaccauggcacgcaggagcagauacaggaacaccacauuggaacaauaaagaagcacucguugaauuuaaagaugcacaugcaaaaagacaaaccgugguaguauugggaucucaagaaggagcaguucacacagcacuagcaggagcauuagaagccgaaauggacggagcaaaaggaagguuaucuucagggcaucuaaaauguagauuaaaaauggacaaacuaagauuaaaagggguaaguuauucacuauguacagcagcuuuuacauucacaaaaauaccugcagaaacacugcacgggacaguaacaguagaaguacaauaugcaggaacagaugguccauguaagguacccgcacaaauggcaguugacaugcaaacucuaacgccaguaggaagacuaaucacagcuaauccaguaauaacagaaucaacugaaaacucaaaaaugaugcuagagcucgauccaccuuucggagauucauacauugugauagguguuggagaaaagaaaauuacacaucauuggcauagaucaggaucaacuauaggaaaagcauuugaagccaccguaagaggagcaaaaagaauggcugugcuaggagauacugccugggauuuuggaaguguaggaggagcauuaaauucacuagggaaaggaauacaucaaauauuuggagcagcauuuaaaucacuauuuggugguaugagcugguuuucacaaauucuaauaggaacauuauuaaugugguuaggucuaaacacuaaaaacggaagcauaucuuuaaugugccuagcacuaggugggguacucauauuucuaagcacugcugugagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6983 - RNA, 2485 nt, Artificial Sequence
  ZIKV prME variant mRNA Design 2 opt
ggggcgcugccuacggagguggcagccaucuccuucucggcaucaagcuuaccaugagaggguuaucaagucgaaaaaggagaucacaugauguuuuaacaguacaauuuuuaauuuugggcaugcuacuuaugacuggagcaguaacaaggagaggaagugccuauuauauguaucuugauagaaaugaugcaggagaagcaauuucauuuccaacaacauuaggaaugaauaaauguuauauacaaauaauggauuuaggacacaugugugaugcaacaaugucauacgaauguccaaugcuagaugaagguguggaaccugaugauguagauugcugguguaacacaacaagcacuuggguaguauacggaacaugucaccacaagaaaggggaagcaagaagaaguagaagggcaguuacccuaccaagccauucaacaagaaaauuacaaacaagaucacaaacauggcuagaaaguagagaauacacaaaacacuuaauaagaguagaaaacuggaucuuuagaaauccaggauucgcacuagcagcugcugcuauugcuuggcuauuaggaagcaguacuagccaaaagguaauauaucuuguuaugauauuacuaauagcaccagcauacucaauaaggugcauaggaguaucaaauagagauuuuguagaaggaauguccggagguacauggguggauauuguacuagaacauggcggcugcgucacagugauggcacaagacaaaccaacaguagauauagaauuaguuacaacaacagucucgaauauggcagaaguaagaaguuauuguuacgaagcaagcauaagugauauggcaagcgacagucggugcccuacucagggagaagcauauuuagauaaacaaucagauacccaauacguauguaaacgaacucuaguagacagaggguggggaaauggauguggacuauuugguaaaggaucacugguaacaugcgcaaaauuugcaugcaguaagaaaaugacaggcaaaaguauucaaccugaaaauuuggaauauagaauaaugcuuagcguacauggaucacaacacucaggaaugauagugaaugauacaggacacgaaacagaugaaaauagagcaaaaguagaaauaacaccuaauaguccuagagcggaagcaacacuaggaggauucggaucauugggucuugacugugaaccacgaacuggguuagauuuuucagaucuauauuauuuaacaaugaauaauaaacauugguuaguacacaaagagugguuccaugauauaccauugccauggcaugcaggagcggauacuggaacaccgcauuggaacaacaaagaagcacuuguagaauuuaaagaugcacaugcaaaaaggcaaacaguaguaguacuuggaucucaagaaggagcaguacauacugcuuuagcaggagcauuagaagcugaaauggauggagcaaaagguagacuaagcucgggacacuuaaaaugcagacuaaagauggauaaauuaagauuaaaaggugugucguacaguuuauguacagcugcauuuaccuuuacuaaaauaccagcagaaacauuacauggcacuguaacaguugaaguacaauaugcaggaaccgaugguccaugcaaaguaccagcucaaauggcaguagauaugcaaacgcuuacuccaguaggaagguuaauaacagcuaauccaguaauaacugaauccaccgaaaauagcaaaaugauguuagaauuagauccaccauuuggggauucauauauaguuauaggaguaggagaaaagaaaauaacucaccauuggcacagaucaggaaguacaauaggaaaagcguucgaagcaacaguaaggggagcaaaacgaauggcaguauuaggagacacagcaugggacuuugguucaguaggcggagcauugaauagcuuaggaaaaggaauacaccagauauuuggcgcagcuuucaagagcuuauuuggaggaaugucgugguuuagccaaauacuaauaggaacuuuauugauguggcuaggacugaacacuaaaaacggaaguauuucauuaauguguuuagcauuaggaggaguauuaaucuuuuuaucaacagcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6984 - RNA, 2524 nt, Artificial Sequence
  KU321639.1 prME-long mRNA Design 2 opt
ggggcgcugccuacggagguggcagccaucuccuucucggcaucaagcuuaccaugcguauaauaaaugcaagaaaagaaaagaaaagaagaggcgcagauacaagcguaggcauaguuggguuacuguuaacaacagcuauggcugcagaaguaacaagaagagguagcgcuuauuacauguauuuagacaggaaugacgcuggagaagcaauuagcuuuccaacaacuuuaggaaugaauaaauguuauauucaaauaauggaucuaggacacaugugcgacgcaaccaugaguuaugaauguccaaugcuagacgaaggaguagaacccgaugauguugauuguugguguaauacaacgucaaccuggguuguauauggcacaugucaucauaagaaaggagaagcaagaagaaguaggagagcaguaacacuaccuucacauucaacuagaaaacuacaaacucguagccaaacauggcuagaaucacgagaauauacaaaacaucugauaagaguagaaaauuggauuuuuagaaauccuggauuugcucuagcugcagccgcaauagcauggcuacuaggaucuaguacuagccaaaaagugauauacuuaguaaugauauuacuaauagcuccugccuacaguauacgcugcauaggaguaagcaauagggacuucguagagggaaugucaggaggcacauggguagauauaguacuagaacacggaggauguguaacaguaauggcccaggauaaaccaacuguagauauugagcuaguaacuacaacuguaucaaacauggcugaagucagaaguuacuguuacgaagcaaguauaagugauauggccucagauucacgauguccaacucaaggagaagccuaucuagauaaacaaucagauacucaauauguauguaaaagaacuuuaguagauagaggcuggggaaauggcuguggauuauuuggaaaaggcagcuuagucacaugcgcaaaauuugccugcagcaagaaaaugacgggaaaaucgauacaaccggaaaauuuagaauauagaauaauguuaucaguacacgggagccaacauucaggaaugauaguaaaugauacaggacacgaaacggaugaaaauagagccaaaguugaaauaacaccuaacaguccaagagcagaagcuacacuagguggauucggcucauuaggauuggauugugaaccacgaacuggcuuagacuucucugacuuauacuacuuaacuaugaauaauaaacauuggcuaguacauaaagaaugguuccaugacaucccuuuaccauggcaugcaggagcagauacaggaacaccucauuggaauaauaaagaagcacuuguagaguucaaagaugcacaugcuaaaagacaaacaguaguaguauuaggaucacaagaaggugccguacacacugcgcuagcuggugcauuagaagcggaaauggauggagccaaaggaagacuaucuuccggacaucuuaaauguagauuaaaaauggauaaacuaagauuaaaaggaguaagcuauaguuuaugcacagcagcuuuuacauuuacaaaaauaccggcagaaacauuacauggaacaguaacaguugaaguucaauaugcgggaacggauggaccuugcaaagucccagcccaaauggcuguggacaugcaaacauuaacgccaguaggaagacucauuaccgcaaauccaguaauaacugaaucaacggaaaacaguaaaaugaugcuagaacuagacccuccauuuggagacagcuauauaguaauaggaguaggagaaaagaaaauaacacaucauuggcaucgaucuggaaguaccaucggaaaagcauuugaagcgacaguacgaggagccaaaagaauggccguauuaggcgauacagcuugggauuucgguucggucggaggcgcauuaaauaguuuaggaaaaggaauacaucaaauuuucggagcagcauucaaaagccuauuugggggcaugagcugguuuucacaaauacucaucgguacuuuauuaauguggcuaggacucaauacgaaaaaugguaguaucucauuaauguguuuagcauuaggcggaguauugauuuuucuuaguacagcaguaagugccgacguaggaugcucaguagauuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6985 - RNA, 2524 nt, Artificial Sequence
  KU312312.1 prME-long mRNA Design 2 opt
ggggcgcugccuacggagguggcagccaucuccuucucggcaucaagcuuaccaugagaauuauaaacgcuagaaaagagaaaaagcguagaggagcugauacaagcguugggauaguagguuuguuacuaacaacagcaauggcagcagaaguuacaagaagagggagugcauauuacauguaucuagacaggaacgaugcuggugaagcaauuucauucccaacaacauuaggaaugaauaaauguuauauacaaauaauggacuuaggacacacaugcgaugcaacaaugucauaugaguguccgauguuagaugagggaguagaaccagaugacguagauuguugguguaauacaacaaguacaugggucguguauggaacaugccaccauaagaaaggagaagcaagaagaaguagacgagcaguaacauuaccaagucacaguacaagaaaacuacaaacuagaagucaaacaugguuagaaucuagagaguauacaaaacacuuaaucagaguagaaaauuggauauuuagaaauccaggauuugcauuagcagcugcggcaauagcuuggcuauuaggaagcucaacaucucaaaaaguaauauauuuaguaaugauacuauuaauagcaccagcuuauagcauaagguguauuggaguaucaaauagagauuucguugaaggaaugucaggaggaacauggguagauguuguucuagaacauggagguugcguuacagucauggcacaagauaaaccaacaguagauauagaauuagucacaacaacaguuaguaacauggcagaaguacgcucauauuguuaugaagcaagcauaagcgauauggcaucagauucaagauguccaacacaaggagaagcauauuuagauaaacaaucugacacacaauauguauguaaacguacguuaguagaccguggaugggggaacggauguggauuauuugguaaaggaucguuaguaacaugcgcaaaauucgcaugcaguaagaaaaugaccggaaaaagcauacaacccgagaacuuagaauauagaauaauguuaagcguacauggcagccaacauaguggaaugaucgucaacgauacaggacaugaaacagaugaaaauagagcuaaaguagaaauaaccccaaacagcccaagagcagaagcaacauuagguggauuugguucacuaggauuagauugcgaaccuagaacgggccuggauuuuagugaccuauacuauuuaacaaugaauaauaaacacugguuaguucauaaagaaugguuucaugauauuccucuaccauggcaugcaggcgcagauacagguacaccacacuggaacaauaaagaagcauuaguagaguucaaagaugcacacgcaaagagacaaacugucgugguacuagguagucaagaaggugcaguucauacagcacucgcaggagcguuagaagcagaaauggauggagcgaaaggaagauugaguucaggucaucuaaaaugccgacuaaaaauggauaaauuaagguuaaaagguguaucauauucauuaugcacagccgcuuucacauuuacaaaaaucccagcagaaacuuuacauggaacaguaacuguagaagugcaauaugccggaaccgauggaccaugcaaagucccugcucaaauggcuguagacaugcaaacauuaacgccaguuggaagacuaauaacagcaaaccccguaauaacggaaagcaccgaaaacagcaaaaugaugcuagaauuagauccaccuuuuggagacaguuauaucguuauaggcguaggcgaaaagaaaauuacccaucauuggcauagaaguggaagcacaauuggcaaagcauucgaggcaacaguaagaggcgccaaaagaauggcugucuuaggagacacagcaugggauuuuggaagugucggaggagcauuaaauagccuuggaaaaggaauacaucaaauauuuggggcagcauucaaaucacuauuuggaggaaugagcugguuuucacaaauuuuaauagguacccuauuaaugugguuaggacuaaaugcuaaaaauggaaguauaaguuuaaugugucuugcauuaggaggaguauuaauauuucuaucaacggcuguaucagcugauguaggauguaguguagacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6986 - RNA, 2512 nt, Artificial Sequence
  AY632535.2 prME-long mRNA Design 2 opt
ggggcgcugccuacggagguggcagccaucuccuucucggcaucaagcuuaccaugagaauaaucaacgcucgaaaagaacgaaaaagaagaggagcagauacuaguauuggcauaauaggucuauuacuuacuaccgcuauggcagcugaaauaacaagaagaggaagcgcauacuacauguauuuagauagaagugaugcaggaaaagcaauuucuuuugcaacgacauugggaguaaauaaaugccacguucaaauaauggaucuaggacauaugugugaugcuacuaugucauacgaauguccgauguuagaugaaggaguagaaccagacgacgucgauuguugguguaauacaaccagcacauggguaguguacggaacaugccaccauaaaaaaggagaggcaagacgaagcaggcgagcaguaacauugccgagucacucaacaagaaaacuacaaacuaggucacaaacaugguuagaaaguagagaauauacaaaacauuuaauaaaaguggaaaauuggauauuuagaaauccaggauucgcucuaguugcuguggcaauagcuugguuauuagguaguaguacuagucaaaaagucauauaucuaguuaugauucuacugauagcaccagccuauucuauaagauguauaggaguaucuaacagagacuuuguagaagguaugucgggaggaacuuggguagauguaguacuagaacauggagguuguguaacggucauggcacaagauaaaccuacuguagacauagaauuaguaacaaccaccguaucgaacauggcagaaguaagaucuuauugcuaugaagcaaguauuagcgauauggcaagcgacucaagaugcccuacucaaggagaagcauacuuagacaaacaguccgauacucaauauguguguaaaagaacuuuaguagauagaggauggggaaacggcuguggacuauuuggcaaaggaucauuagugacaugugcaaaauuuacauguagcaaaaagaugacagguaaaaguauacaaccagaaaauuuagaauacagaauaauguuaaguguacauggcucucaacauagcggaaugauaggauaugaaacagaugaggauagagcaaaaguagaaguaacaccuaauaguccucgugcagaagcaacucuggguggauucggaagccuaggauuggauugugaaccacgaacaggauuagauuuuagugaucuauauuacuuaacaaugaauaauaaacauuggcuaguccauaaagaaugguuucaugacauuccauuaccauggcacgcaggugcagauaccggaacaccacacuggaauaauaaagaagcuuuaguagaauuuaaagacgcgcaugcaaagaggcaaacggugguaguauugggaucacaagagggagcaguacauacagcucuagcaggagcacuugaagcagagauggacggugcaaaaggaagauuauuuucaggacacuuaaaauguagacucaaaauggauaaauuaagguuaaaaggagucagcuauagcuuaugcacagcagcauuuacauucacaaaaguaccagcagagacauuacaugggacaguuacaguugaaguacaauaugcgggaacagauggaccauguaaaauacccgugcaaauggcaguugacaugcaaacauuaacaccuguaggaagauuaauuacagcgaacccaguaauaacagaaucuacagaaaauaguaaaaugauguuagaacuagacccaccauuuggagauaguuauauagugauaggagugggugauaaaaaaaucacacaucacuggcauaggaguggaucuacuauuggaaaagcuuuugaagcaacaguaagaggagcaaaaagaauggcaguuuuaggagauacagcaugggauuucggaagcguaggagggguauuuaauagccuagggaaagguauucaucaaauauuuggagccgcauuuaaaagucuauucgguggaaugaguugguucucacagauauuaauaggaacauuauuagucugguuaggauuaaauacaaaaaaugggucaauaucucugacaugucuagcacuagguggaguaaugauauuucuaaguacagcaguaagcgcagaugucggauguagcguagacuuuucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
